United States Patent
Hou et al.

(10) Patent No.: US 12,084,676 B2
(45) Date of Patent: Sep. 10, 2024

(54) CAS9 ORTHOLOGS

(71) Applicant: PIONEER HI-BRED INTERNATIONAL, INC., Johnston, IA (US)

(72) Inventors: Zhenglin Hou, Ankeny, IA (US); Joshua K. Young, Johnston, IA (US); Giedrius Gasiunas, Vilnius (LT); Virginijus Siksnys, Vilnius (LT)

(73) Assignee: PIONEER HI-BRED INTERNATIONAL, INC., Johnston, IA (US)

( * ) Notice: Subject to any disclaimer, the term of this patent is extended or adjusted under 35 U.S.C. 154(b) by 1567 days.

(21) Appl. No.: 16/282,498

(22) Filed: Feb. 22, 2019

(65) Prior Publication Data

US 2019/0264232 A1 Aug. 29, 2019

Related U.S. Application Data

(60) Provisional application No. 62/651,991, filed on Apr. 3, 2018, provisional application No. 62/634,257, filed on Feb. 23, 2018.

(51) Int. Cl.
| | |
|---|---|
| *C12N 15/90* | (2006.01) |
| *C12N 9/22* | (2006.01) |
| *C12N 9/78* | (2006.01) |
| *C12N 15/10* | (2006.01) |
| *C12N 15/11* | (2006.01) |
| *C12N 15/113* | (2010.01) |
| *C12N 15/52* | (2006.01) |
| *C12N 15/85* | (2006.01) |

(52) U.S. Cl.
CPC ............. *C12N 15/907* (2013.01); *C12N 9/22* (2013.01); *C12N 9/78* (2013.01); *C12N 15/102* (2013.01); *C12N 15/11* (2013.01); *C12N 15/113* (2013.01); *C12N 15/52* (2013.01); *C12N 15/85* (2013.01); *C12N 15/902* (2013.01); *C07K 2319/00* (2013.01); *C12N 2310/20* (2017.05); *C12N 2800/80* (2013.01)

(58) Field of Classification Search
CPC .......... C12N 15/907; C12N 9/22; C12N 9/78; C12N 15/102; C12N 15/11; C12N 15/113; C12N 15/52; C12N 15/85; C12N 15/902; C12N 2310/20; C12N 2800/80; C07K 2319/00
See application file for complete search history.

(56) References Cited

U.S. PATENT DOCUMENTS

| | | | |
|---|---|---|---|
| 5,036,006 A | 7/1991 | Sanford | |
| 5,959,177 A | 9/1999 | Hein et al. | |
| 6,410,329 B1 | 6/2002 | Hansen et al. | |
| 7,292,055 B2 | 8/2007 | Choo et al. | |
| 8,012,752 B2 | 9/2011 | Jayakumar et al. | |
| 8,575,424 B2 | 11/2013 | Yau et al. | |
| 8,581,036 B2 | 11/2013 | Samboju et al. | |
| 8,586,361 B2 | 11/2013 | Tao et al. | |
| 8,609,420 B2 | 12/2013 | Samuel et al. | |
| 8,653,327 B2 | 2/2014 | Samboju et al. | |
| 8,680,366 B2 | 3/2014 | Eudes et al. | |
| 8,697,359 B1 | 4/2014 | Zhang | |
| 8,722,410 B2 | 5/2014 | Samuel et al. | |
| 8,771,945 B1 | 7/2014 | Zhang | |
| 8,795,965 B2 | 8/2014 | Zhang | |
| 8,865,406 B2 | 10/2014 | Zhang | |
| 8,871,445 B2 | 10/2014 | Cong et al. | |
| 8,889,356 B2 | 11/2014 | Zhang | |
| 8,889,418 B2 | 11/2014 | Zhang et al. | |
| 8,895,308 B1 | 11/2014 | Zhang | |
| 8,906,616 B2 | 12/2014 | Zhang | |
| 8,932,814 B2 | 1/2015 | Cong | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,163,284 B2 | 10/2015 | Liu et al. | |
| 9,187,755 B2 | 11/2015 | Samuel et al. | |
| 9,382,548 B2 | 7/2016 | Eudes et al. | |
| 9,476,057 B2 | 10/2016 | Samuel et al. | |

(Continued)

FOREIGN PATENT DOCUMENTS

| | | |
|---|---|---|
| DE | 102015006335 | 11/2016 |
| WO | 2005049842 | 6/2005 |

(Continued)

OTHER PUBLICATIONS

Witte (Development Genes and Evolution 225 (2015): 55-62) (Year: 2015).*
Joung (Nature protocols 12.4 (2017): 828-863) (Year: 2017).*
Adler (Microbiology 46.2 (1967): 175-184) (Year: 1967).*
Geisinger (Nucleic acids research 44.8 (2016): e76-e76) (Year: 2016).*

(Continued)

*Primary Examiner* — Nancy J Leith
*Assistant Examiner* — Kyle T Rega

(57) ABSTRACT

Compositions and methods are provided for novel Cas9 orthologs, including, but not limiting to, novel guide polynucleotide/Cas9 endonucleases complexes, single or dual guide RNAs, guide RNA elements, and Cas9 endonucleases. The present disclosure also describes methods for creating a double strand break in a target polynucleotide, methods for genome modification of a target sequence under various in vivo and in vitro conditions, in the genome of a cell, for gene editing, and for inserting a polynucleotide of interest into the genome of a cell. Also provided are nucleic acid constructs and cells having a modified target site or altered polynucleotide of interest produced by the methods described herein.

43 Claims, 23 Drawing Sheets

Specification includes a Sequence Listing.

(56) References Cited

U.S. PATENT DOCUMENTS

| | | |
|---|---|---|
| 9,493,782 B2 | 11/2016 | Cigan et al. |
| 9,719,108 B2 | 8/2017 | Samuel et al. |
| 9,834,791 B2 | 12/2017 | Zhang et al. |
| 9,840,713 B2 | 12/2017 | Zhang |
| 9,885,033 B2 | 11/2018 | Joung |
| 10,208,298 B2 | 2/2019 | Frisch et al. |
| 10,227,576 B1 | 3/2019 | Cameron et al. |
| 10,266,850 B2 | 4/2019 | Doudna et al. |
| 10,329,547 B1 | 6/2019 | Cameron et al. |
| 10,787,654 B2* | 9/2020 | Barrangou ............. C12N 15/85 |
| 10,934,536 B2 | 3/2021 | Hou et al. |
| 2004/0231016 A1 | 11/2004 | Wang et al. |
| 2007/0083945 A1 | 4/2007 | Byrum et al. |
| 2007/0178593 A1 | 8/2007 | Miller et al. |
| 2007/0199095 A1 | 8/2007 | Allen et al. |
| 2008/0047031 A1 | 2/2008 | Tao et al. |
| 2009/0070891 A1 | 3/2009 | Foley et al. |
| 2009/0104700 A1 | 4/2009 | Samuel et al. |
| 2009/0133152 A1 | 5/2009 | Lyznik et al. |
| 2010/0076057 A1 | 3/2010 | Sontheimer |
| 2010/0159598 A1 | 6/2010 | Jayakumar et al. |
| 2010/0311168 A1 | 12/2010 | Samuel et al. |
| 2010/0313293 A1 | 12/2010 | Albertsen et al. |
| 2011/0035836 A1 | 2/2011 | Eudes et al. |
| 2011/0165679 A1 | 7/2011 | Gordon-Kamm et al. |
| 2011/0203012 A1 | 8/2011 | Dotson et al. |
| 2011/0247100 A1 | 10/2011 | Samboju et al. |
| 2012/0023619 A1 | 1/2012 | Samboju et al. |
| 2012/0023620 A1 | 1/2012 | Yau et al. |
| 2012/0244569 A1 | 9/2012 | Samuel et al. |
| 2013/0157369 A1 | 6/2013 | Miller |
| 2013/0198888 A1 | 8/2013 | Falco et al. |
| 2013/0263324 A1 | 10/2013 | Lassner et al. |
| 2014/0017212 A1* | 1/2014 | Rebar ................... C12N 15/907 424/94.6 |
| 2014/0020131 A1 | 1/2014 | Bidney |
| 2014/0068797 A1 | 3/2014 | Doudna |
| 2014/0090113 A1 | 3/2014 | Cogan et al. |
| 2014/0096284 A1 | 4/2014 | Martin-Ortigosa et al. |
| 2014/0179006 A1 | 6/2014 | Zhang |
| 2014/0179770 A1 | 6/2014 | Zhang |
| 2014/0182012 A1 | 6/2014 | Eudes et al. |
| 2014/0186843 A1 | 7/2014 | Zhang |
| 2014/0186919 A1 | 7/2014 | ZHang |
| 2014/0186958 A1 | 7/2014 | Zhang |
| 2014/0189896 A1 | 7/2014 | Zhang |
| 2014/0227787 A1 | 8/2014 | Zhang |
| 2014/0234972 A1 | 8/2014 | Zhang |
| 2014/0242664 A1 | 8/2014 | Zhang |
| 2014/0242699 A1 | 8/2014 | Zhang |
| 2014/0242700 A1 | 8/2014 | Zhang |
| 2014/0242702 A1 | 8/2014 | Chen |
| 2014/0242703 A1 | 8/2014 | Samuel et al. |
| 2014/0248702 A1 | 9/2014 | Zhang |
| 2014/0256046 A1 | 9/2014 | Zhang |
| 2014/0273231 A1 | 9/2014 | Zhang et al. |
| 2014/0273232 A1 | 9/2014 | Zhang et al. |
| 2014/0273234 A1 | 9/2014 | Zhang |
| 2014/0273235 A1 | 9/2014 | Voytas |
| 2014/0310830 A1 | 10/2014 | Zhang |
| 2014/0335620 A1 | 11/2014 | Zhang |
| 2014/0342456 A1 | 11/2014 | Mali |
| 2014/0357530 A1 | 12/2014 | Zhang |
| 2014/0370558 A1 | 12/2014 | Mathis |
| 2015/0044191 A1 | 2/2015 | Liu et al. |
| 2015/0044772 A1 | 2/2015 | Zhao |
| 2015/0045546 A1 | 2/2015 | Siksnys et al. |
| 2015/0059010 A1 | 2/2015 | Cigan |
| 2015/0067922 A1 | 3/2015 | Yang |
| 2015/0079681 A1 | 3/2015 | Zhang |
| 2015/0082478 A1 | 3/2015 | Cigan et al. |
| 2015/0118216 A1* | 4/2015 | Liu .......................... A61P 43/00 435/375 |
| 2015/0166980 A1 | 6/2015 | Liu et al. |
| 2015/0167000 A1 | 6/2015 | Voytas |
| 2015/0167009 A1 | 6/2015 | D'Halluin |
| 2015/0225734 A1 | 8/2015 | Voytas et al. |
| 2015/0284727 A1 | 10/2015 | ToolGen |
| 2015/0291967 A1 | 10/2015 | Mathis |
| 2016/0024524 A1 | 1/2016 | Joung |
| 2016/0032297 A1 | 2/2016 | Deschamps et al. |
| 2016/0145631 A1 | 5/2016 | Voytas et al. |
| 2016/0201072 A1 | 7/2016 | Cigan et al. |
| 2016/0208271 A1 | 7/2016 | Cigan et al. |
| 2016/0208272 A1 | 7/2016 | Cigan et al. |
| 2016/0251667 A1 | 9/2016 | Cigan et al. |
| 2016/0289659 A1 | 10/2016 | Doudna et al. |
| 2016/0304846 A1 | 10/2016 | Liu et al. |
| 2016/0340746 A1 | 11/2016 | Makarov et al. |
| 2017/0022521 A1 | 1/2017 | Samuel et al. |
| 2017/0029880 A1 | 2/2017 | Fang et al. |
| 2017/0121693 A1 | 5/2017 | Liu et al. |
| 2017/0166912 A1 | 6/2017 | Brower-Toland |
| 2017/0183677 A1 | 6/2017 | Gao et al. |
| 2018/0002715 A1 | 1/2018 | Cigan et al. |
| 2018/0057832 A1 | 3/2018 | Li |
| 2018/0087104 A1 | 3/2018 | Joung et al. |
| 2018/0142222 A1* | 5/2018 | Sternberg ................. C12Q 1/44 |
| 2018/0142263 A1 | 5/2018 | May et al. |
| 2018/0163203 A1 | 6/2018 | Bennett et al. |
| 2018/0230476 A1 | 8/2018 | Cigan et al. |
| 2018/0258417 A1 | 9/2018 | Cigan et al. |
| 2018/0258438 A1 | 9/2018 | Chaky et al. |
| 2018/0273960 A1 | 9/2018 | Cigan et al. |
| 2018/0282763 A1 | 10/2018 | Cigan et al. |
| 2018/0320226 A1 | 11/2018 | Church et al. |
| 2018/0327785 A1 | 11/2018 | Cigan et al. |
| 2018/0334688 A1 | 11/2018 | Gersbach et al. |
| 2018/0346895 A1 | 12/2018 | Cigan et al. |
| 2018/0371479 A1 | 12/2018 | Cigan et al. |
| 2019/0032036 A1 | 1/2019 | Zhang et al. |
| 2019/0040405 A1 | 2/2019 | Cigan et al. |
| 2019/0093090 A1 | 3/2019 | Chittoor et al. |
| 2019/0100745 A1 | 4/2019 | Cigan et al. |
| 2019/0100762 A1 | 4/2019 | Cigan et al. |
| 2019/0136248 A1 | 5/2019 | Cigan et al. |
| 2019/0161742 A1 | 5/2019 | Cigan et al. |
| 2020/0017879 A1 | 1/2020 | Doudna et al. |
| 2020/0080112 A1 | 3/2020 | Zhang et al. |
| 2020/0087640 A1 | 3/2020 | Doudna et al. |
| 2020/0172886 A1 | 6/2020 | Doudna et al. |
| 2020/0190487 A1 | 6/2020 | Zhang et al. |
| 2020/0190494 A1 | 6/2020 | Hou et al. |
| 2020/0224160 A1 | 7/2020 | Ding et al. |
| 2021/0139874 A1 | 5/2021 | Hou et al. |
| 2021/0163908 A1 | 6/2021 | Hou et al. |
| 2021/0166783 A1 | 6/2021 | Shmakov et al. |
| 2022/0010293 A1 | 1/2022 | Hou et al. |
| 2022/0073890 A1 | 3/2022 | Hou et al. |
| 2023/0084762 A1 | 3/2023 | Gasiunas et al. |
| 2023/0119655 A1 | 4/2023 | Hou et al. |

FOREIGN PATENT DOCUMENTS

| | | |
|---|---|---|
| WO | 2007025097 | 3/2007 |
| WO | 2009042164 | 4/2009 |
| WO | 2010011961 | 1/2010 |
| WO | 2010077319 | 7/2010 |
| WO | 2011143124 | 11/2011 |
| WO | 2012129373 | 9/2012 |
| WO | WO-2012164565 A1 | 12/2012 |
| WO | WO-2013019411 A1 | 2/2013 |
| WO | 2013066423 | 5/2013 |
| WO | 2013068845 | 5/2013 |
| WO | 2013098244 | 7/2013 |
| WO | 2013112686 | 8/2013 |
| WO | 2013141680 | 9/2013 |
| WO | 2013142578 | 9/2013 |
| WO | 2013173535 | 11/2013 |
| WO | 2013176772 | 11/2013 |
| WO | 2014018423 | 1/2014 |
| WO | 2014065596 | 5/2014 |
| WO | 2014071006 | 5/2014 |
| WO | 2014093479 | 6/2014 |

(56) References Cited

FOREIGN PATENT DOCUMENTS

| | | |
|---|---|---|
| WO | 2014093635 | 6/2014 |
| WO | 2014093694 | 6/2014 |
| WO | 2014093712 | 6/2014 |
| WO | 2014093768 | 6/2014 |
| WO | WO-2014089290 A1 | 6/2014 |
| WO | 2014144155 | 9/2014 |
| WO | 2014144761 | 9/2014 |
| WO | 2014150624 | 9/2014 |
| WO | WO-2014164466 A1 | 10/2014 |
| WO | WO-2014165825 A2 | 10/2014 |
| WO | 2014186686 | 11/2014 |
| WO | 2014194190 | 12/2014 |
| WO | 2015006294 | 1/2015 |
| WO | WO-2015006747 A2 | 1/2015 |
| WO | 2015026883 | 2/2015 |
| WO | 2015026885 | 2/2015 |
| WO | 2015026886 | 2/2015 |
| WO | 2015026887 | 2/2015 |
| WO | 2015071474 | 5/2015 |
| WO | WO-2015070083 A1 | 5/2015 |
| WO | 2015112896 | 7/2015 |
| WO | 2015131101 | 9/2015 |
| WO | 2015189693 | 12/2015 |
| WO | 2016007347 | 1/2016 |
| WO | 2016033298 | 3/2016 |
| WO | WO-2016040030 A1 | 3/2016 |
| WO | WO-2016149352 A1 | 9/2016 |
| WO | 2016186946 | 11/2016 |
| WO | WO-2016205613 A1 | 12/2016 |
| WO | WO-2017015015 A1 | 1/2017 |
| WO | 2017034971 | 3/2017 |
| WO | 2017062855 | 4/2017 |
| WO | WO-2017066497 A2 | 4/2017 |
| WO | WO-2017070032 A1 | 4/2017 |
| WO | WO-2017117395 A1 | 7/2017 |
| WO | WO-2017132239 A1 | 8/2017 |
| WO | 2017155714 | 9/2017 |
| WO | 2017155715 | 9/2017 |
| WO | WO-2017155717 A1 | 9/2017 |
| WO | WO-2017212264 A1 | 12/2017 |
| WO | WO-2017218185 A1 | 12/2017 |
| WO | WO-2018035250 A1 | 2/2018 |
| WO | WO-2018035388 A1 | 2/2018 |
| WO | WO-2018064371 A1 | 4/2018 |
| WO | WO-2018172556 A1 | 9/2018 |
| WO | WO-2018197495 A1 | 11/2018 |
| WO | WO-2018197520 A1 | 11/2018 |
| WO | WO-2019074841 A1 | 4/2019 |
| WO | WO-2019084148 A1 | 5/2019 |
| WO | WO-2019089808 A1 | 5/2019 |
| WO | WO-2019089820 A1 | 5/2019 |
| WO | 2019183150 A1 | 9/2019 |
| WO | WO-2019168953 A1 | 9/2019 |
| WO | WO-2019177978 A1 | 9/2019 |
| WO | WO-2019178428 A1 | 9/2019 |
| WO | WO-2019217354 A1 | 11/2019 |
| WO | WO-2019217358 A1 | 11/2019 |
| WO | WO-2019217816 A1 | 11/2019 |
| WO | WO-2020086908 A1 | 4/2020 |
| WO | WO-2020102659 A1 | 5/2020 |

OTHER PUBLICATIONS

Gu (Trends in biotechnology 33.3 (2015): 172-179) (Year: 2015).*
Nakajima (PLoS One 12.5 (2017): e0177966) (Year: 2017).*
Patrick D. Hsu et al., DNA targeting specificity of RNA-guided Cas9 nucleases, Nature Biotechnology, Sep. 2013, pp. 827-834, vol. 31, No. 9.
Woong Y. Hwang et al., Efficient In Vivo Genome Editing Using RNA-Guided Nucleases, Nature Biotech, Mar. 2013, pp. 227-229, vol. 31, No. 3.
Steve Lin et al: "Enhanced homology-directed human genome engineering by controlled timing of CRISPR/Cas9 delivery", eLIFE, 3:e04766, Dec. 15, 2014.
W. Jiang et al., "Demonstration of CRISPR/Cas9/sgRNA-mediated targeted gene modificaiton in *Arabidopsis*, tobacco, sorghum and rice", Nucleic Acids Research, Sep. 2, 2013, pp. e188-e188, XP055219328, vol. 41 No. 20.
Wenyan Jiang et al., RNA-guided editing of bacterial genomes using CRISPR-Cas systems, Nature Biotechnology, Mar. 2013, p. 233, vol. 31, No. 3.
Wenzhi Jiang et al., "Efficient CRISPR/Cas9-mediated gene edigin in *Arabidopsis thalian* and inheritance of modified genes in the T2 and T3 generations", PLoS One, vol. 9 No. 6, Jun. 11, 2014, p. e99225, XP055219594.
Wenyan Jiang et al: "CRISPR-Cas: New tools for genetic manipulations of bacterial immunity systems", Annual Review of Microbiology, vol. 69, No. 1, Jul. 22, 2015, pp. 209-228, figure 1.
Martin Jinek et al., A Programmable Dual-RNA-Guided DNA Endonuclease in Adaptive Bacterial Immunity, Science, Aug. 17, 2012, pp. 816-821, vol. 337.
Martin Jinek et al., RNA-programmed genome editing in human cells, eLife, 2013, e00471, pp. 1-9.
Ross A. Johnson et al., A rapid assay to quantify the cleavage efficiency of custom-designed nucleases in planta, Plant Mol Biol, 2013, pp. 207-221, vol. 82.
Jung, "Challenges in Wide Implementation of Genome Editing for Crop Improvement", JCropSciBiotech, 2017, vol. 20 No. 2 pp. 129-135.
Kanchiswamy C N et al: "Non-GMO genetically edited crop plants", Trends in Biotechnology, vol. 33 No. 9, Sep. 1, 2015, XP002765281.
Tautvydas Karvelis et al: "Rapid characterization of CRISPR-Cas9 protospacer adjacent motif sequence elements", Genome Biology, vol. 30 No 1, Nov. 19, 2015, p. 1335.
Sojung Kim et al: Highly efficient RNA-guided genome editing in human cells via delivery of purified Cas9 ribonucleoproteins, Genome Res, vol. 24, Apr. 2, 2014, pp. 1012-1019.
Hyeran Kim et al: "Targeted genome editing for crop improvement", Plant Breeding and Biotechnology, vol. 3, No. 4, Dec. 30, 2015, pp. 283-290.
Eugene V. Koonin et al., CRISPR-Cas Evolution of an RNA-based adaptive immunity system in prokaryotes, RNA Biology, May 2013, pp. 679-686, vol. 10:5.
Vinay Kumar et al: "The CRISPR_Cas system for plant genome editing: advances and opportunities", Journal of Experimental Botany, vol. 66, No. 1, Nov. 4, 2014, pp. 47-57, figure 3, table 3.
Kun Xu et al: Efficient genome engineering in eukaryotes using Cas9 from *Streptococcus thermophilus*, Cellular and Molecular Life Sciences, vol. 72 No. 2, Jul. 20, 2014, pp. 383-399.
Leblanc, C et al: "Increased efficiency of targeted mutgenesis by CRISPR/Cas9 in plants using heat stress", The Plant Journal, 2017, vol. 93, pp. 377-386.
Lei S. Qi et al., Repurposing CRISPR as an RNA-Guided Platform for Sequence-Specific Control of Gene Expression, Cell, Feb. 28, 2013, pp. 1173-1183, vol. 152(5).
MT Leonard et al: "Complete genome sequences of Lactobacillus johnsonii Strain N6.2 and Lacctobacillus reuteri Strain TD1", Genome Announcements, vol. 2 No. 3, May 8, 2014.
Li et al., "In vivo genome editing restores hemostasis in a mouse model of hemophilia", Nature, 2011, pp. 217-221, vol. 475 No. 7355.
Li et al. High-efficiency TALEN-based gene editing produces disease-resistant rice. Nat Biotechnol. May 7, 2012, pp. 390-392, vol. 30 No. 5.
Jian-Feng Li et al., Multiplex and homologous recombination-mediated genome editing in *Arabidopsis* and Nicotiana benthamiana using guide RNA and Cas9, Nature Biotechnology, Aug. 2013, pp. 688-691, vol. 31, No. 8.
Li, "Comparative Analysis of the Base Compositions of the Pre-mRNA 3' Cleaved-Off Region and the mRNA 3' Untranslated Region Relative to the Genomic Base Composition in Animals and Plants" PLoS One, Jun. 2014, vol. 9 Issue 6, e99928.
Li Zhongsen et al: "Cas9-guide RNA directed genome editing in soybean", Plant Physiology, vol. 169 No. 2, Oct. 2015, pp. 960-970, XP002765282.

(56) References Cited

OTHER PUBLICATIONS

Michael R. Lieber et al., The Mechanism of Double-Strand DNA Break Repair by the Nonhomologous DNA End Joining Pathway, Annu Rev Biochem, 2010, pp. 181-211, vol. 79.
Song Luo, et al: "Non-transgenic plant genome editing using purified sequence-specific nucleases", Mol Plant, vol. 8, Jun. 11, 2015, 1425-1427.
Ming Ma et al., A Guide RNA Sequence Design Platform for the CRISPR/Cas9 System for Model Organism Genomes, BioMed Research International, 2013, 4 pages, Article ID 270805.
Morgan L. Maeder et al., CRISPR RNA-guided activation of endogenous human genes, Nature Methods, Oct. 2013, pp. 977-979, vol. 10, No. 10.
Kira S. Makarova et al., Evolution and classification of the CRISPR-Cas systems, Nat Rev Microbiol, Jun. 2011, pp. 467-477, vol. 9(6).
Prashant Mali et al., RNA-Guided Human Genome Engineering via Cas9, Sciencexpress, Feb. 15, 2013, pp. 823-826, vol. 15, 339(6121).
Prashant Mali et al., CAS9 transcriptional activators for target specificity screening and paired nickases for cooperative genome engineering, Nat. Biotechnol., Sep. 2013, pp. 833-838, vol. 31(9).
Zhiyong Mao et al., Comparison of nonhomologous end joining and homologous recombination in human cells, DNA Repair, 2008, 7:1765-1771.
Yanfei Mao et al., Application of the CRISPR-Cas System for Efficient Genome Engineering in Plants, Molecular Plant, Nov. 2013, pp. 2008-2011, vol. 6, No. 6.
Luciano A. Marraffini et al., CRISPR Interference Limits Horizontal Gene Transfer in Staphylococci by Targeting DNA, Science, Dec. 19, 2008, pp. 1843-1845, vol. 322(5909).
Luciano A. Marraffini et al., CRISPR interference: RNA-directed adaptive immunity in bacteria and archaea, Nat Rev Genet, Mar. 2010, pp. 181-190, vol. 11(3).
Susana Martin-Ortigosa et al: "Mesoporous silica nanoparticle-mediated intracellular Cre protein delivery for maize genome editing via loxP sigte excision", Plant Physio, vol. 164, Issue 2, Feb. 2014, pp. 537-547.
Susana Martin-Ortigosa et al: "Proteolistics: a biolistic method for intracellular delivery of proteins", Transgenic Res, vol. 23, Aug. 5, 2014, pp. 743-756.
Jin Miao et al., Targeted mutagenesis in rice using CRISPR-Cas System, Cell Research, 2013, pp. 1233-1236, vol. 23.
Jeffrey C. Miller et al., A TALE nuclease architecture for efficient genome editing, Nature Biotechnology, Feb. 2011, pp. 143-148, vol. 29.
F. J. Mojica et al., Biological significance of a family of regularly spaced repeats in the genomes of Archaea, Bacteria and mitochondria, Molecular Microbiology, May 2000, pp. 244-246, vol. 36.
Vladimir Nekrasov et al., Targeted mutagenesis in the model plant Nicotiana benthamiana using Cas9 RNA-guided endonuclease, Nature Biotechnology, pp. 691-693, vol. 31, No. 8, Aug. 2013.
J.-H. Oh et al: "CRISPR-Cas9-assisted recombineering in Lactobacillus reuteri", Nucleic Acids Research, vol. 42 No 17, Sep. 29, 2014, p. e131 (and Supplemental).
Paul Joseph W III et al: "CRISPR/Cas9 for plant genome editing: accomplishments, problems and prospects", Plant Cell Reports, Springer International, DE, vol. 35, No. 7, Apr. 25, 2016, pp. 1417-1427, figure 4.
Phillips, "The challenge of gene therapy and DNA delivery", Pharm Pharmacology, 2001, 1169-1174 vol. 53.
Nancy Podevin et al., Site-directed nucleases: a paradigm shift in predictable, knowledge-based plant breeding, Trends in Biotechnology, Jun. 2013, pp. 375-383, vol. 31, No. 6.
Qiudeng Que et al: "Maize transformation technology development for commercial event generation", Frontiers in Plant Science, vol. 5, Aug. 5, 2014, pp. 12-15.
Que, "Repurposing Macromolecule Delivery Tools for Plant Genetic Modification", 2019, Methods and Protocols, Methods in Molecular Biology, vol. 1864, Chapter One.
Ramakrishna et al: "Gene disruption by cell-penetrating peptide-mediated delivery of Cas9 protein and guide RNA", Genome Res 24:1020-27 (Apr. 2014).
William Ainley et al: "Trait stacking via targeted genome editing", Plant Biotechnology Journal, Aug. 19, 2013, pp. 1126-1134, vol. 11, No. 9.
Anonymous: "cas9-CRISPR-associated endonuclease CAs9—Bacillus cereus VD131—cas9 gene & protein", UniProt database entry: R8LDU5.
Anonymous: hypothetical protein [Lactobacillus reuteri]: NCBI Reference Sequence WP_019251774.1.
Claesson, "CRISPR-associated endonuclease Cas9, Lactobacillus salivarius (strain UCC118): Q1WVK1_LACS1", UniProt, 2006.
Anonymous: "Lactobacillus reuteri TD1, complete genome, NCBI Reference Sequence: NC_021872.1".
Rodolphe Barrangou et al., CRISPR Provides Acquired Resistance Against Viruses in Prokaryotes, Science, 2007, pp. 1709-1712, vol. 315.
Rodolphe Barrangou et al., RNA-mediated programmable DNA cleavage, Nature Biotechnology, Sep. 2012, pp. 836-838, vol. 30, No. 9.
Rodolphe Barrangou et al., CRISPR-Cas sytems and RNA-guided interference, WIREs RNA, 2013, pp. 267-278, vol. 4.
Barrangou & Marraffini, "CRISPR-Cas systems: prokaryotes upgrade to adaptive immunity", Mol Cell 54:234-44 (Apr. 2014).
Peter R. Beetham, A tool for functional plant genomics: Chimeric RNA/DNA oligonucleotides cause in vivo gene-specific mutations, Proc. Natl., Acad. Sci USA, Plant Biology, Jul. 1999, pp. 8774-8778, vol. 96.
Khaoula Belhaj et al., Plant genome editing made easy: targeted mutagenesis in model and crop plants using the CRISPR/Cas system, Plant Methods, 2013, pp. 39-48, vol. 9.
Beurdeley et al: "Compact designer TALENs for efficient genome engineering", Nat Commun, Apr. 23, 2013, pp. 1-8, vol. 4, No. 1762.
Joseph Bondy-Denomy et al: "To acquire or resist: the complex biological effects of CRISPR-Cas systems", Trends in Microbiology, vol. 22 No. 4, Feb. 26, 2014, pp. 218-225.
Luisa Bortesi et al: "The CRISPR/Cas9 system for plant genome editing and beyond", Biotechnology Advances, vol. 33 No. 1, Jan. 1, 2015, pp. 41-52, XP055217852.
Briner Alexandra E et al: "Guide RNA functional modules direct Cas9 activity and orthogonality", Molecular Cell, vol. 56 No. 2, Oct. 16, 2014, pp. 333-339 (and Supplemental).
Nannan Chang et al., Genome editing with RNA-guided Cas9 nuclease in Zebrafish embryos, Cell Research, 2013, pp. 465-472, vol. 23.
Cheng et al: "Multiplexed activation of endogenous genes by CRISPR-on, an RNA-guided transcriptional activator system", Cell Research, 2013, pp. 1163-1171, vol. 23.
Seung Woo Cho et al., Targeted genome engineering in human cells with the Cas9 RNA-guided endonuclease, Nature Biotechnology, Mar. 2013, pp. 230-232, vol. 31, No. 3.
Krzysztof Chylinski et al., The tracrRNA and Cas9 families of type II CRISPR-Cas immunity systems, RNA Biology, May 2013, pp. 726-737, vol. 10, No. 10.
Claesson M J et al: "Multireplicon genome architecture of Lactobacillus salivarius", PNAS, Apr. 1, 2006, pp. 6718-6723, vol. 103 No. 17.
Le Cong et al., Multiplex Genome Engineering Using CRISPR/Cas Systems, Sciencexpress Reports, Jan. 3, 2013, pp. 1-7, vol. 1.
Elitza Deltcheva et al., CRISPR RNA maturation by trans-encoded small RNA and host factor RNase III, Nature, Mar. 31, 2011, pp. 602-607, vol. 471.
Kathleen D'Halluin et al., Targeted molecular trait stacking in cotton through targeted double-strand break induction, Plant Biotechnology Journal, pp. 933-941, vol. 11, Jun. 18, 2013.
James E. Dicarlo et al., Genome engineering in *Saccharomyces cerevisiae* using CRISPR-Cas systems, Nucleic Acids Research, Mar. 4, 2013, pp. 4336-4343, vol. 41, No. 7.
Doudna & Charpentier, "The new frontier of genome engineering with CRISPR-Cas9", Sci 346(6213):1258096 (2014).

(56) References Cited

OTHER PUBLICATIONS

Lukas E Dow et al: "Inducible in vivo genome editing with CRISPR-Cas9", Nature Biotechnology, vol. 33, No. 4, Feb. 18, 2015, pp. 390-394.
Kevin M Esvelt et al: "Orthogonal Cas9 proteins for RNA-guided gene regulation and editing", Nature Methods, Sep. 29, 2013, pp. 1116-1121, vol. 10 No. 11.
Robert D. Fagerlund et al: "The Cpf1 CRISPR-Cas protein expands genome-editing tools", Genome Biology, vol. 523, No. 1, Dec. 17, 2015, p. 481.
Zhengyan Feng et al., Efficient genome editing in plants using a CRISPR/Cas system, Cell Research, 2013, pp. 1229-1232, vol. 23.
Fichtner et al: "Precision genetic modifications: a new era in molecular biology and crop improvement", Planta 239:921-39 (2014).
Ines Fonfara et al: "The CRISPR-associated DNA-cleaving enzyme Cpf1 also processes precursor CRISPR RNA", Nature, vol. 532, Apr. 20, 2016, pp. 517-521.
Yanfang Fu et al., Improving CRISPR-Cas nuclease specificity using truncated guide RNAs, Nature Biotechnology, Mar. 2014, vol. 32, No. 3.
Todd Funke et al., Structural Basis of Glyphosate Resistance Resulting from the Double Mutation Thr 97 lle and Pro101 Ser in 5-Enolpyruvylshikimate-e-phosphate synthase from *Escherichia coli*. J Biol Chem vol. 284 No. 15 pp. 9854-9860, Apr. 10, 2009.
Thomas Gaj et al., ZFN, TALEN and CRISPR/Cas-based methods for genome engineering, Trends Biotechnology, Jul. 2013, pp. 397-405, vol. 31(7).
Gardlik et al., "Vectors and delivery systems in gene therapy", Med Sci Monit, 2005, RA110-121, vol. 11 No. 14.
Josiane E. Garneau et al., The CRISPR/Cas bacterial immune system cleaves bacteriophase and plasmid DNA, Nature, 2010, pp. 67-71, vol. 468.
Giedrius Gasiunas et al., Cas9-crRNA ribonucleoprotein complex mediates specific DNA cleavage for adaptive immunity in bacteria, PNAS, Sep. 4, 2012, e2579-2586.
Luke A Gilbert et al., CRISPR-Mediated Modular RNA-Guided Regulation of Transcription in Eukaryotes, Cell, Jul. 18, 2013, pp. 442-451, vol. 154(2).
Gong et al., DNA unwinding is the primary determinant of CRISPR-Cas9 activity, 2018, Cell Reports, pp. 359-371, vol. 22 Issue 9.
Scott J. Gratz et al., Genome Engineering of Drosophila with the CRISPR RNA-Guided Cas9 Nuclease, Aug. 2013, Genetics, pp. 1029-1035, vol. 194.
Grissa I et al: "CRISPRFinder: a web tool to identify clustered regularly interspaced short palindromic repeats", Nucleic Acids Research, Information Retrieval Ltd, GB, May 31, 2007, pp. W52-W57, vol. 35.
Guillinger etl al.: "Fusion of catalytically inactive Cas9 to Fok1 nuclease improves the specificity of genome modification", Nat Biotech 32(6):577-83 (2014).
Daniel H. Haft et al., A Guild of 45 CRISPR-Associated (Cas) Protein Families and Multiple CRISPR/Cas Subtypes Exist in Prokaryotic Genomes, PLoS Computational Biol, Nov. 11, 2005.
Caryn R. Hale et al. , RNA-Guided RNA Cleavage by a CRISPR RNA-Cas Protein Complex, Cell, Nov. 25, 2009, pp. 945-956, vol. 139.
Rachel E. Haurwitz et al., Sequence- and Structure-Specific RNA Processing by a CRISPR Endonuclease, Science, Sep. 10, 2010, pp. 1355-1358, vol. 329.
Heler, "Cas9 specifies functional viral targets during CRISPR-Cas adaptation", Nature, 2015, vol. 519, p. 199.
Philippe Horvath et al., Diversity, Activity, and Evolution of CRISPR Loci in *Streptococcus thermophilus*, Journal of Bacteriology, Feb. 2008, pp. 1401-1412, vol. 190, No. 4.
Philippe Horvath et al., CRISPR/Cas, the Immune System of Bacteria and Archaea, Science, Jan. 8, 2010, pp. 167-170, vol. 327.
Houdebine, "The methods to generate transgenic animals and to control transgene expression", J Biotech, 2002, 145-160, vol. 98.

Zhonggang Hou et al., Efficient genome engineering in human pluripotent stem cells using Cas9 from Neisseria meningitides, PNAS, Sep. 24, 2013, pp. 15644-15649, vol. 110, No. 39.
Sivaprakash Ramalingam et al., A CRISPR way to engineer the human genome, Genome Biology, 2013, 4 pages, vol. 14 (Feb. 26, 2013).
Reeks et al., "CRISPR interference: a structural perspective.", 2013, Biochem J, pp. 155-166, vol. 453.
Relic et al., Interaction of the DNA modifying proteins VirD1 and VirD2 of Agrobacterium tumefaciens: Analysis by subcellular localization in mammalian cells, Proc Natl Acad Sci, 2008, 95:9105-9110.
Retallack et al, "A single base pair mutation changes the specificities of both a transcription activation protein and its binding site", PNAS, Oct. 1993, pp. 9562-9565, vol. 90.
Rueda et al, Nature Communications, 2017, 8:1610.
Leenay Ryan T et al: "Identifying and visualizing functional PAM diversity across CRISPR-Cas systems", Molecular Cell, Cell Press, Cambridge, MA, US, vol. 62 No 1, Mar. 31, 2016, pp. 137-147 and Supplemental.
Paul D. Sadowski, Site-specific genetic recombination: hops, flips, and flops, FASEB, 1993, pp. 760-767, vol. 7.
Neville E. Sanjana et al., A Transcription Activator-Like Effector (TALE) Toolbox for Genome Engineering, Nat. Protoc, 2012, pp. 171-192, vol. 7(1).
Rosemary Sanozky-Dawes et al: "Occurrence and activity of a type II CRISPR-Cas system in Lactobacillus gasseri", Microbiology, vol. 161, No. 9, Sep. 1, 2015, pp. 1752-1761, figure 2.
Rimantas Sapranauskas et al., The *Streptococcus thermophilus* CRISPR/Cas system provides immunity in *Escherichia coli* Nucleic Acids Research, Aug. 2011, pp. 9275-9282, vol. 39, No. 21.
Brian Sauer, Site-specific recombination: developments and applications, Current Opinion in Biotechnology, 1994, pp. 521-527, vol. 5.
Schaeffer Scott M et al: "The expanding footprint of CRISPR/CAs9 in the plant sciences", Plant Cell Reports, Springer International, DE, vol. 35, No. 7, Apr. 30, 2016, pp. 1451-1468.
Shiraz A Shah et al: "Protospacer recognition motifs", RNA Biology, May 1, 2013, pp. 1547-6286, vol. 10 No. 5.
Qiwei Shan et al., Targeted genome modification of crop plants using a CRISPR-Cas system, Nature Biotechnology, Aug. 2013, pp. 686-688, vol. 31, No. 8.
Bin Shen et al., Generation of gene-modified mice via Cas9/RNA-mediated gene targeting, Cell Research, May 2013, pp. 720-723, vol. 23, No. 5.
Vipula K Shukla et al: Precise genome modificaiton in the crop species *Zea mays* using zinc-finger nucleases, Nature, Apr. 29, 2009, p. 437, vol. 459, No. 7245.
Sinkunas Tomas et al: "Cas3 is a single-stranded DNA nuclease and ATP-dependent helicase in the CRISPR/Cas immune system", EMBO, vol. 30 No. 7, Apr. 2011, pp. 1335-1342.
Strauss, "Zinc Fingers, TAL Effectors, or Cas9-Based DNA Binding Proteins: What's Best for Targeting Desired Genome Loci?", MolecularPlant, Sep. 2013, vol. 6 No. 5 pp. 1384-1387.
Sergei Svitashev et al: "Targeted mutagenesis, precise gene editing, and site-specific gene insertion in maize using Cas9 and guide RNA", Plant Physiology, vol. 169, No. 2, Aug. 12, 2015, pp. 931-945.
Bruno Tinland et al., The T-DNA-linked VirD2 protein contains two distinct functional nuclear localization signals, Proc. Natl. Acad. Sci, Aug. 1992, pp. 7442-7446, vol. 89.
Ui-Tei et al, "Functional dissection of siRNA sequence by systematic DNA substitution: modified siRNA with a DNA seed arm is a powerful tool for mammalian gene silencing with significantly reduced off-target effect" Nucleic Acid Res. 2008, pp. 2146-2151, vol. 36 No. 7.
John Van Der Oost, New Tool for Genome Surgery, Science, Feb. 15, 2013, pp. 768-770, vol. 339.
Daniel F. Voytas, Plant Genome Engineering with Sequence-Specific Nucleases, Annual Review of Plant Biology, pp. 327-350, vol. 64, Mar. 1, 2013.

(56) References Cited

OTHER PUBLICATIONS

Ming-Bo Wang et al., Hairpin RNAs derived from RNA polymerase II and polymerase III promoter-directed transgenes are processed differently in plants, RNA, May 2008, pp. 903-913, vol. 14 No. 5.
Jianbin Wang et al., Targeted gene addition to a predetermined site in the human genome using a ZFN-based nicking enzyme, Genome Research, 2012, pp. 1316-1326.
Haoyi Wang et al., One-Step Generation of Mice Carrying Mutations in Multiple Genes by CRISPR/Cas-Mediated Genome Engineering, Cell, May 9, 2013, pp. 910-918, vol. 153(4).
Westra et al: "CRISPR immunity relies on the consecutive binding and degradation of negatively supercoiled invader DNA by Cascade and Cas3", Mol Cell, Apr. 19, 2012,pp. 595-605, vol. 46 No. 5.
Blake Wiedenheft et al., RNA-guided genetic silencing systems in bacteria and archaea, Nature, Feb. 16, 2012, pp. 331-338, vol. 482.
Je Wook Woo et al: "DNA-free genome editing in plants with preassembled CRISPR-Cas9 ribonucleoproteins", Nature Biotechnology, vol. 33 No. 11, Oct. 19, 2015, pp. 1162-1164, XP055290196.
Wu, "Tn5 transposase-assisted transformation of indica rice", Plant J, 2015, pp. 186-200, vol. 68.
Kabin Xie et al., RNA-Guided Genome Editing in Plants Using a CRISPR-Cas System, Nov. 2013, Molecular Plant, pp. 1975-1983, vol. 6, No. 6.
Chaoyou Xue et al: "CRISPR interference and priming varies with individual spacer sequences", Nucleic Acids Research, vol. 43 No 22, Nov. 19, 2015, pp. 10831-10847.
Bernd Zetsche et al: "Cpf1 is a single RNA-guide endonuclease of a Class 2 CRISPR-Cas system", Cell, vol. 163 No. 3, Oct. 1, 2015, pp. 759-771, XP055267511.
Zhang, "Transcription Activator-Like Effector Nucleases Enable Efficient Plant Genome Engineering",Plant Physiology, 2013, vol. 161, pp. 20-27.
Liang Zhen et al: "Targeted mutagenesis in *Zea mays* using TALENs and the CRISPR/Cas system", Journal of Genetics and Genomics, Dec. 14, 2013, pp. 63-68, vol. 41, No. 2.
Alicja Ziemienowicz, Import of Agrobacterium T-DNA into plant nuclei: two distinct functions of VirD2 and VirE2 proteins, The Plant Cell, 2001, 13:369-383.
John A Zuris, et al: "Cationic lipid-mediated delivery of proteins enables efficient protein-based genome editing in vitro and in vivo", Nature Biotech, vol. 33 No. 1, Oct. 30, 2014, pp. 73-80.
Zhang et al., "The CRISPR/Cas9 system produces specific and homozygous targeted gene editing in rice in one generation", Plant Biotech J, 2014, vol. 12 No. 6, pp. 797-807.
Xing e al., "A CRISPR/Cas9 toolkit for multiplex genome editing in plants", BMC Plant Biol, 2014, vol. 14 No. 1, pp. 327-338.
Hyun et al., "Site-directed mutagenesis in *Arabisopsis thaliana* using divided tissue-targeted RGEN of the CRISPR/Cas system to generate heritable null alleles", Planta, Jan. 2015, vol. 241 No. 1, pp. 271-284.
Jacobs et al, "Targeted genome modifications in soybean with CRISPR/Cas9", BMC Biotechnology, Mar. 2015, vol. 15 No. 1, 10 pages.
Database UniProt 24 "RecName: Full-CRISPR-associated endonuclease Cas9" retrieved from EBI accession No. UniProt:A0A0F4LLE0.
Database RefSEQ NCBI, database accession WP_010710291.1, "Type II CRISPR-RNA-guided endonuclease Cas9 [Enterococcus faecalis]".
Database RefSEQ NCBI, database accession WP_023519017, "Type II CRISPR-RNA-guided endonuclease Cas9 [Enterococcus mundtii]".
Database RefSEQ NCBI, database accession WP_031455829, "Type II CRISPR-RNA-guided endonuclease Cas9 [Flavobacterium chungangense]".
Database RefSEQ NCBI, database accession WP_048395223, "Type II CRISPR-RNA-guided endonuclease Cas9 [Pseudomonas Iini]".
Muller M., et al., "*Streptococcus thermophilus* CRISPR-Cas9 Systems Enable Specific Editing of the Human Genome," Molecular Therapy, 2016, vol. 24, No. 3, pp. 636-644.
Partial Supplementary European Search Report for European Application No. 21760860.3, mailed Mar. 14, 2024, 13 Pages.

"Transposase Armatimonadota Bacterium," XP093136014, retrieved from EBI accession No. UniProt A0A399WQY8, 1 pages, 2023.
Abdullah R., et al., "Efficient Plant Regeneration aaafrom Rice Protoplasts through Somatic Embryogenesis," Nature Bio Technology, Dec. 1986, vol. 4, 4 Pages.
Abler M.L., et al, "Control of mRNA Stability in Higher Plants," Plant Molecular Biology, 1996, vol. 32, pp. 63-78.
Ali Z., et al., "Efficient Virus-Mediated Genome Editing in Plants using the CRISPR/Cas9 system," Molecular Plant, Aug. 2015, vol. 8, pp. 1288-1291.
Anonymous: "CRISPR-associated endonuclease Cas9/Csn1," Database Uniprotkb [Online] Jun. 1, 2001, XP055467792, Database Accession No. Q99ZW2.
Application Forum: "A Streamlined Method for the Production, Screening, and Application of sgRNAs for CRISPR/Cas9 Gene Editing," Sponsored Paper, BioTechniques, 2014, vol. 57, No. 3, p. 157.
Bae S., et al., "Cas-OFFinder: A Fast and Versatile Algorithm that Searches for Potential Off-Target sites of Cas9 RNA-Guided Endonucleases," Bioinformatics, 2014, vol. 30, No. 10, pp. 1473-1475.
Baltes N.J., et al., "DNA Replicons for Plant Genome Engineering," The Plant Cell, Jan. 2014, vol. 26, No. 1, pp. 151-163.
Bashir K., et al., "Expression and Enzyme Activity of Glutathione Reductase is Upregulated by Fe-Deficiency in Graminaceous Plants," Plant Molecular Biology, 2007, vol. 65, pp. 277-284.
Begemann M.B., et al., "Precise Insertion and Guided Editing of Higher Plant Genomes using Cpf1 CRISPR Nucleases," BioRxiv, 2017, 16 Pages, DOI: http://dx.doi.orgi/10.1101/109983.
Bollen Y., et al: "How to Create State-of-The-Art Genetic Model Systems: Strategies for Optimal CRISPR-Mediated Genome Editing," Nucleic Acids Research, 2018, vol. 46, No. 13, pp. 6435-6454.
Bolotin A., et al., "Clustered Regularly Interspaced Short Palindrome Repeats (CRISPRs) have Spacers of Extrachromosomal Origin," Microbiology, Accepted on May 30, 2005, vol. 151, pp. 2551-2561.
Bolotin A., et al., "Complete Sequence and Comparative Genome Analysis of the Dairy Bacterium *Streptococcus thermophilus*," Nature Biotechnology, Dec. 2004, vol. 22, No. 12, pp. 1554-1558, 6 Pages.
Briner A.E., et al., "Guide RNA Functional Modules Direct Cas9 Activity and Orthogonality," Molecular Cell, Oct. 23, 2014, vol. 56, No. 2, pp. 333-339.
Burstein D., et al., "New CRISPR-Cas Systems from Uncultivated Microbes," Nature, Feb. 9, 2017, vol. 542, pp. 237-241 (plus supplementary material).
Carte J., et al., "Cas6 is an Endoribonuclease that Generates Guide RNAs for Invader Defense in Prokaryotes," Genes and Development, 2008, vol. 22, pp. 3489-3496.
Cenik E.S., et al., "Argonaute Proteins," Current Biology, 2011, vol. 21, No. 12, pp. R446-449.
Cermak T., et al., "A Multipurpose Toolkit to Enable Advanced Genome Engineering in Plants," The Plant Cell, Jun. 2017, vol. 29, pp. 1196-1217.
Chang Y-J., et al., "Complete Genome Sequence of Acidaminococcus Fermentans Type Strain (VR4T)," Standards in Genomic Sciences, 2010, vol. 3, pp. 1-14.
Chen J.S., et al., "CRISPR-Cas12a Target Binding Unleashes Indiscriminate Single-Stranded DNase Activity," Science, Apr. 27, 2018, vol. 360, pp. 436-439.
Chen S., et al., "Highly Efficient Mouse Genome Editing by CRISPR Ribonucleoprotein Electroporation of Zygotes," The Journal of Biological Chemistry, US, Jul. 8, 2016, vol. 291, No. 28, pp. 14457-14467, DOI: 10.1074/jbc.M116.733154, ISSN 0021-9258, XP055363781.
Cho S.W., et al., "Analysis of Off-Target Effects of CRISPR/Cas-Derived RNA-Guided Endonucleases and Nickases," Genome Research, 2014, vol. 24, pp. 132-141.
Christou P., et al., "Stable Transformation of Soybean Callus by DNA-Coated Gold Particles," Plant Physiology, 1988, vol. 87, pp. 671-674.

(56) References Cited

OTHER PUBLICATIONS

Chylinski K., et al., "Classification and Evolution of Type II CRISPR-Cas Systems," Nucleic Acids Research, Published on Apr. 11, 2014, vol. 42, No. 10, pp. 6091-6105.
Database ENA: "Brevibacillus Laterosporus GI-9 HNH Endonuclease Family Protein," Database Accession No. CCF15452, 2012, XP002788584, Retrieved from EBI.
Database GenBank [online], Accession No. RLG21245, Oct. 15, 2018, [Search Date: Dec. 4, 2023], URL: https://www.ncbi.nlm.nih.gov/protein/1491131739?sat=37&satkey=328989054.
Database GenBank [online], Accession No. AYF54542, Oct. 4, 2018,[ Search Date: Dec. 4, 2023], URL: https://www.ncbi.nlm.nih.gov/protein/1486619893?sat=4&satkey=230973912.
Database GenBank [online], Accession No. OAT71859, Jun. 3, 2016, [Search Date: Dec. 4, 2023], URL: https://www.ncbi.nlm.nih.gov/protein/1034235848?sat=37&satkey=291469548.
Database GenBank [online], Accession No. PWI54866, May 21, 2018, [Search Date: Dec. 4, 2023], URL: https://www.ncbi.nlm.nih.gov/protein/1390407570?sat=37&satkey=321854836.
Database GenBank [online], Accession No. RGG75438, Aug. 31, 2018, [Search Date: Dec. 4, 2023], URL: https://www.ncbi.nlm.nih.gov/protein/1466314872?sat=37&satkey=327072516.
Database GenBank [online], Accession No. RJP56748, Sep. 2, 2018, [Search Date: Dec. 4, 2023], URL: https://www.ncbi.nlm.nih.gov/protein/1482987796?sat=37&satkey=328371167.
Database: "Using Cpf1 for CRISPR," Benchling, Jan. 1, 2015, 4 Pages, Retrieved from URL: https://benchling.com/pub/cpf1, XP55396832.
Djukanovic V., et al.,"Male-Sterile Maize Plants Produced by Targeted Mutagenesis of the Cytochrome P450-like Gene (MS26) Using a Re-Designed I-CreI Homing Endonuclease," The Plant Journal, Nov. 5, 2013, vol. 76, No. 5, pp. 888-899.
Djukic M., et al., "Genome Seqence of Brevibacillus Laterosporus LMG 15441, a Pathogen of Invertebrates," Journal of Bacteriology, American Society for Micorbiology, US, Oct. 2011, vol. 193, No. 19, pp. 5535-5536.
Dong D., et al., "The Crystal Structure of Cpf1 in complex with CRISPR RNA," Nature, 2016, 16 pages, doi:10.1038/nature17944.
Ellegaard K.M., et al., "Extensive Intra-phylotype Diversity in Lactobacilli and Bifidobacteria from the Honeybee Gut," BMC Genomics, Apr. 2015, vol. 16, No. 1, Article No. 284, 22 pages.
Endo A., et al., "Efficient Targeted Mutagenesis of Rice and Tobacco Genomes Using Cpf1 From Francisella Novicida," Nature Scientific Reports, 2016, vol. 6, 38169, 9 pages.
Endo M., et al., "Toward Establishing an Efficient and Versatile Gene Targeting System in Higher Plants," Biocatalysis and Agricultural Biotechnology, 2014, vol. 3, pp. 2-6.
Extended European Search Report for European Application No. 19757558.2, mailed Nov. 8, 2021, 11 Pages.
Extended European Search Report for European Application No. 19894559.4, mailed Dec. 5, 2022, 10 Pages.
Florez S.L., et al., "Enhanced Somatic Embryogenesis in Theobroma Cacao using the Homologous Baby Boom Transcription factor," BMC Plant Biology, 2015, vol. 15, No. 121, 13 pages.
Fujita J., et al., "The Point Mutation in the Promoter Region and the Single Nucleotide Polymorphism in Exon 1 of the Cytokeratin 19 Gene in Human Lung Cancer Cell Lines," Lung Cancer, Dec. 2001, vol. 34, No. 3, pp. 387-394.
Gabriel R., et al., "An Unbiased Genome-Wide Analysis of Zinc-Finger Nuclease Specificity," Nature Biotechnology, Sep. 2011, vol. 29, No. 9, pp. 816-823.
Ganal W.M., et al.; "A Large Maize (Zea mays L.) Snp Genotyping Array: Development and Germplasm Genotyping and Genetic Mapping to Compare with the B73 Reference Genome," PLoS One, Dec. 2011, vol. 6, Issue 12(e28334), 15 Pages.
Gao F., et al., "DNA-Guided Genome Editing Using the Natronobacterium Gregoryi Argonaute," Nature Biotechnology, Published on May 2, 2016, DOI:10.1038/nbt.3547, 7 Pages.

Garside E.L., et al., "Cas5d Processes Pre-crRNA and is a Member of a Larger Family of CRISPR RNA Endonucleases," RNA, 2012, vol. 18, No. 11, pp. 2020-2028.
Gilles A.F., et al., "Efficient CRISPR-mediated Gene Targeting and Transgene Replacement in the Beetle Tribolium Castaneum," The Company of Biologists Limited, Development, 2015, vol. 142, pp. 2832-2839.
Glenn T.C., et al., "Field Guide to Next-Generation DNA sequencers," Molecular Ecology Resources, 2011, vol. 11, pp. 759-769.
Guilinger P., et al., "Broad Specificity Profiling of Talens Results In Engineered Nucleases With Improved DNA-Cleavage Specificity," Nature Methods, Apr. 2014, vol. 11, No. 4, pp. 429-435, (Published online on Feb. 16, 2014).
Harrington L.B., et al., "Programmed DNA Destruction by Miniature CRISPR-Cas14 Enzymes," Science, Nov. 16, 2018, vol. 362, pp. 839-842.
Hidalgo-Cantabrana C., et al., "Characterization and Applications of Type I CRISPR-Cas Systems," Biochemical Society Transactions, 2020, vol. 48, No. 1, pp. 15-23.
Hinchee M.A.W., et al., "Production of Transgenic Soybean Plants Using Agrobacterium-mediated DNA Transfer," Bio/Technology, Aug. 1988, vol. 6, pp. 915-922, DOI: 10.1038/nbt0888-915, XP002045224.
Hink M.A., et al., "Structural Dynamics of Green Fluorescent Protein Alone and Fused with a Single Chain Fv Protein," The Journal of Biological Chemistry, Jun. 9, 2000, vol. 275, No. 23, pp. 17556-17560.
Hochstrasser M.L., et al., "Cutting it Close: CRISPR-Associated Endoribonuclease Structure and Function," Trends in Biochemical Sciences, Jan. 2014, vol. 40, No. 1, pp. 58-66.
Hsu P.D., et al., "Development and Applications of CRISPR-Cas9 for Genome Engineering," Cell, Jun. 5, 2014, vol. 157, pp. 1262-1278.
Huang T.P., et al., "Circularly Permuted and PAM-modified Cas9 Variants Broaden the Targeting Scope of Base Editors," Nature Biotechnology, Jun. 2019, vol. 37, pp. 626-631, 9 Pages.
Husaini A.M., et al., "Vehicles and ways for Efficient Nuclear Transformation in Plants," GMCrops, 2010, vol. 1, No. 5, pp. 276-287.
International Preliminary Report on Patentability for International Application No. PCT/US2019/019086, mailed Sep. 3, 2020, 10 Pages.
International Preliminary Report on Patentability for International Application No. PCT/US2019/066118, mailed Jun. 24, 2021, 11 Pages.
International Preliminary Report on Patentability for International Application No. PCT/US2021/017593, mailed Sep. 9, 2022, 10 Pages.
International Preliminary Report on Patentability for International Application No. PCT/US2021/071839, mailed Apr. 27, 2023,10 Pages.
International Search Report and Written Opinion for International Application No. PCT/US2019/019086, mailed Jun. 28, 2019, 16 Pages.
International Search Report and Written Opinion for International Application No. PCT/US2019/066118, mailed Jun. 2, 2020, 15 Pages.
International Search Report and Written Opinion for International Application No. PCT/US2021/017593, mailed Jul. 9, 2021, 15 Pages.
International Search Report and Written Opinion for International Application No. PCT/US2021/071839, mailed Apr. 6, 2022, 14 Pages.
Jacoby K., et al., "Expanding LAGLIDADG Endonuclease Scaffold Diversity by Rapidly Surveying Evolutionary Sequence Space," Nucleic Acids Research, vol. 40, No. 11, pp. 4954-4964, (Published online on Feb. 14, 2012).
Jore M.M., et al., "Structural Basis for CRISPR RNA-guided DNA Recognition by Cascade," Nature Structural & Molecular Biology, May 2011, vol. 18, No. 5, pp. 529-537 (and Supplemental).
Karvelis T., et al., "PAM Recognition by Miniature CRISPR-Cas14 Triggers Programmable Double-Stranded DNA Cleavage," bioRxiv, May 30, 2019, 10 Pages, DOI: http://dx.doi.org./10.101/654897.

(56) References Cited

OTHER PUBLICATIONS

Kim G.B., et al., "Isolation and Characterization of Medicago Truncatula U6 Promoters for the Construction of Small Hairpin RNA-Mediated Gene Silencing Vectors," Plant Molecular Biology Reporter, Jun. 2014, 2013, vol. 31, No. 3, pp. 581-593.

Kim H., et al., "CRISPR/Cpf1-Mediated DNA-Free Plant Genome Editing," Nature Communications, Published Feb. 16, 2017, vol. 8, No. 14406, DOI: 10.1038/ncomms14406.

Kim H.Y., et al., "Chimeric crRNAs with 19 DNA Residues in the Guide Region Show the Retained DNA Cleavage Activity of Cas9 with Potential to Improve the Specificity," Chemical Communications, Feb. 28, 2019, vol. 55, pp. 3552-3555.

Kindle K.L., et al., "High-frequency Nuclear Transformation of Chlamydomonas Reinhardtii," Proceedings of the National Academy of Sciences of the United States of America, Feb. 1990, vol. 87, pp. 1228-1232.

Kocak D.D., et al., "Increasing the Specificity of CRISPR Systems with Engineered RNA Secondary Structures," Nature Biotechnology, Jun. 2019, vol. 37, pp. 657-666.

Koo T., et al., "Measuring and Reducing Off-Target Activities of Programmable Nucleases Including CRISPR-Cas9," Molecules and Cells, 2015, vol. 38, No. 6, pp. 475-481.

Koonin E.V., et al., "Diversity, Classification and Evolution of CRISPR-Cas Systems," Current Opinion in Microbiology, 2017, vol. 37, pp. 67-78.

Kuscu C., et al., "Genome-Wide Analysis Reveals Characteristics of Off-Target Sites Bound by the Cas9 Endonuclease," Nature Biotechnology, Jul. 2014, vol. 32, No. 7, pp. 677-683, (Published Online on May 18, 2014).

Lee C.M., et al., "Nuclease Target Site Selection for Maximizing on-Target Activity and Minimizing Off-Target Effects in Genome Editing," Molecular Therapy: The Journal of the American Society of Gene Therapy, Mar. 1, 2016, vol. 24, No. 3, pp. 475-487.

Li L., et al., "Challenges in CRISPR/CAS9 Delivery: Potential Roles of Nonviral Vectors," Human Gene Therapy, 2015, vol. 26, No. 7, pp. 452-462, 16 Pages.

Li S., et al., "Synthesis-Dependent Repair of Cpf1-Induced Double Strand DNA Breaks Enables Targeted Gene Replacement in Rice," Journal of Experimental Botany, Jun. 28, 2018, vol. 69, No. 20, pp. 4715-4721.

Li X., et al., "Varied Transcriptional Efficiencies of Multiple *Arabidopsis* U6 Small Nuclear RNA Genes," Journal of Integrative Plant Biology, 2007, vol. 49, No. 2, pp. 222-229.

Li Z., et al., "Site-Specific Integration of Transgenes in Soybean via Recombinase-Mediated DNA Cassette Exchange," Plant Physiology, Nov. 1, 2009, vol. 151, No. 3, pp. 1087-1095.

Liang X., et al., "Rapid and Highly Efficient Mammalian Cell Engineering via Cas9 Protein Transfection," Journal of Biotechnology, May 21, 2015, vol. 208, pp. 44-53.

Liang Z., et al., "Efficient DNA-free Genome Editing of Bread Wheat Using CRISPR/Cas9 Ribonucleoprotein Complexes," Nature Communications, Jan. 18, 2017, vol. 8, No. 14261, 5 Pages.

Liu J-J., et al., "CasX Enzymes Comprise a Distinct Family of RNA-guided Genome Editors," Nature, Feb. 14, 2019, vol. 566, pp. 218-240 (Incl. Supplementary Material).

Maier L-K., et al., "An Active Immune Defense with a Minimal CRISPR (Clustered Regularly Interspaced Short Palindromic Repeats) RNA and without the Cas6 Protein," The Journal of Biological Chemistry, Feb. 13, 2015, vol. 290, No. 7, pp. 4192-4201, 11 Pages.

Majorek K.A., et al., "The RNase H-Like Superfamily: New Members, Comparative Structural Analysis and Evolutionary Classification," Nucleic Acids Research, 2014, vol. 42, No. 7, pp. 4160-4179.

Makarova K.S., et al., "An Updated Evolutionary Classification of CRISPR-Cas Systems," Nature Reviews Microbiology, Nov. 2015, vol. 13, 15 Pages, DOI: 10.1038/nrmicro3569.

Makarova K.S., et al., "The Basic Building Blocks and Evolution of CRISPR-Cas Systems," Biochemical Society Transactions, 2013, vol. 41, No. 6, pp. 1392-1400 (and Supplemental).

Mandal P.K., et al., "Efficient Ablation of Genes in Human Hematopoietic Stem and Effector Cells Using CRISPR/Cas9," Cell Stem Cell, Nov. 6, 2014, vol. 15, No. 5, pp. 643-652.

Maruyama T., et al., "Corrigendum: Increasing the Efficiency of Precise Genome Editing with CRISPR-Cas9 by Inhibition of Non-homologous End Joining," Nature Biotechnology, May 2015, vol. 33, No. 5, pp. 538-542, 9 Pages.

Mir A., et al., "Type II-C CRISPR-Cas9 Biology, Mechanism and Application," ACS Chemical-Biology, Feb. 10, 2018, Epub Dec. 20, 2017, vol. 13, No. 2, pp. 1-4; p. 1, 1st paragraph; p. 2, 3rd and 4th paragraphs; p. 3, 1st paragraph; fig. 1B, 18 Pages, DOI:10.1021/acschemblo.7b00855.

Murugan K., et al., "The Revolution Continues: Newly Discovered Systems Expand the CRISPR-Cas Toolkit," Molecular Cell, Oct. 5, 2017, vol. 68, No. 1, pp. 15-25, DOI:10.1016/j.molcel.2017.09.007, XP085207633.

Naito Y., et al., "CRISPRdirect: Software for Designing CRISPR/Cas Guide RNA with Reduced off-target Sites," Bioinformatics, 2015, vol. 31, No. 7, pp. 1120-1123, (Received, Revised, Accepted on 2014).

Nakade S., et al., "Cas9, Cpf1 and C2c1/2/3—What's Next," Bioengineered, 2017, vol. 8, No. 3, pp. 265-273.

Nam K.H., et al., "Cas5d Protein Processes Pre-crRNA and Assembles into a Cascade-like Interference Complex in Subtype I-C/Dvulg CRISPR-Cas System," Structure, Sep. 5, 2012, vol. 20, pp. 1574-1584.

Natsume T., et al., "Hybridization Energies of Double Strands Composed of DNA, RNA, PNA and LNA," Chemical Physical Letters, 2007, vol. 434, pp. 133-138.

NCBI: "CRISPR-Associated Protein Cas9 [Prevotella Histicola JCM 15637 = DNF00424]," NCBIGenPept, Database Accession No. KGF29309, Jul. 9, 2014, 2 Pages. [Retrieved on Jun. 9, 2019] Retrieved from the URL: https://www.ncbi.nlm.nih.gov/protein/690782330.

Nirenberg M., et al., "Historical Review: Deciphering the Genetic code—a Personal Account," Trends in Biochemical Sciences, 2003, Jan. 2004, vol. 29, No. 1, pp. 46-54.

Nishimasu H., et al., "Crystal Structure of Cas9 in Complex with Guide RNA and target DNA," Cell, 2014, vol. 156, pp. 935-949, DOI:10.1016/j.cell.2014.02.001, ISSN 0004312170, XP028667665.

Nishimasu H., et al., "Structures and Mechanisms of CRISPR RNA-Guided Effector Nucleases," Current Opinion in Structural Biology, 2017, vol. 43, pp. 68-78.

O'Brien A., et al., "GT-Scan: Identifying Unique Genomic Targets," Bioinformatics, May 23, 2014, vol. 30, No. 18, pp. 2673-2675.

Oliviera., et al., GenBank Database Accession No. A0A2U3DON8_9BACL, 2018, 3 pages.

Overbeek M.V., et al., "DNA Repair Profiling Reveals Nonrandom Outcomes at Cas9-Mediated Breaks," Molecular Cell, Elsevier, Amsterdam, NL, Aug. 18, 2016, vol. 63, No. 4, pp. 633-646, 15 Pages, Published Online Aug. 4, 2016, DOI: 10.1016/J.Molcel.2016. 06.037, ISSN 1097-2765, XP029690136.

Ow D.W., "Recombinase-Mediated Gene Stacking as a Transformation Operating System," Journal of Integrative Plant Biology, 2011, vol. 53, No. 7, pp. 512-519.

Pacher M., et al., "From Classical Mutagenesis to Nuclease-Based Breeding—Directing Natural DNA Repair for a Natural End-Product," The Plant Journal, Mar. 11, 2017, vol. 90, pp. 819-833, XP055650815.

Partial Supplementary European Search Report for European Application No. 19894559.4, mailed Aug. 10, 2022, 10 Pages.

Pattanayak V., et al., "High-Throughput Profiling of Off-Target DNA Cleavage Reveals RNA-Programmed Cas9 Nuclease Specificity," Nature Biotechnology, Published on Aug. 11, 2013, Sep. 2013, vol. 31, No. 9, pp. 839-843.

Peng N., et al., "A Synthetic Arabinose-Inducible Promoter Confers High Levels of Recombinant Protein Expression in Hyperthermophilic Archaean Sulfolobus Islandicus," Applied and Environmental Microbiology, Aug. 2012, vol. 78, No. 16, pp. 5630-5637.

Pickar-Oliver A., et al., "Targeted Transcriptional Modulation with Type I CRISPR-Cas Systems in Human Cells," Nature Biotechnology, Dec. 2019, vol. 37, pp. 1493-1501, 13 Pages.

(56) References Cited

OTHER PUBLICATIONS

Puchta H., et al., "Gene Replacement by Homologous Recombination in Plants," Plant Molecular Biology, 2002, vol. 48, pp. 173-182.
Puchta H., et al., "Synthetic Nucleases for Genome Engineering in Plants: Prospects for a Bright Future," The Plant Journal, 2014, vol. 78, pp. 727-741.
Que Q., et al., "Trait Stacking in Transgenic Crops Challenges and Opportunities," GM Crops, Jul.-Oct. 2010, vol. 1, No. 4, pp. 220-229.
Quinn T.P., et al, "A Streamlined Method for the Production, Screening, and Application of SgRNAs for CRISPR/Cas Gene Editing," Molecular Therapy, May 2014, vol. 22, Supplement 1, pp. S127-S128,(#336).
Rath D., et al., "Type I-E CRISPR-Cas System as an Immune System in a Eukaryote," BioRxiv, 2018, 20 Pages, DOI:10.1101/357301.
Rueda et al, "Mapping the sugar dependency for rational generation of a DNA-RNA hybrid-guided Cas9 andonuclease". Nature Communications, 2017, 8:1610, XP055688584 (and Supplemental).
Rusk N., "New Kid on the CRISPR Block," Nature Methods, 2015, vol. 12, No. 12, p. 1117.
Sanders R., "Scientists Find New and Smaller CRISPR Gene Editor: CasX," Phys Org, Feb. 5, 2019, 2 Pages.
Schirle N.T., et al., "Structural Basis for MicroRNA Targeting," Science, Oct. 31, 2014, vol. 346, Issue. 6209, pp. 608-613.
Schlake T., et al., "Use of Mutated FLP Recognition Target (FRT) Sites for the Exchange of Expression Cassettes at Defined Chromosomal Loci," Biochemistry, 1994, vol. 33, No. 43, pp. 12746-12751.
Shmakov S., et al., "Discovery and Functional Characterization of Diverse Class 2 CRISPR-Cas Systems," Molecular Cell, US, Oct. 22, 2015, vol. 60, No. 3, pp. 385-397, DOI:10.1016/j.molcel.2015.10.008, ISSN 1097-2765, XP055267512.
Shmakov S., et al., "Diversity and Evolution of Class 2 CRISPR-Cas Systems," Nature Reviews Microbiology, 2017, vol. 15, No. 3, pp. 1-14, Published Online Jan. 23, 2017.
Sinkunas T., et al., "In Vitro Reconstitution of Cascade-Mediated CRISPR Immunity in *Streptococcus thermophilus*," The EMBO Journal, 2013, vol. 32, No. 3, pp. 385-394.
Sodeinde O.A., et al., "Homologous Recombination in the Nuclear Genome of Chlamydomonas Reinhardtii," Proceedings of the National Academy of Sciences of the United States of America, Oct. 1993, vol. 90, pp. 9199-9203.
Song Q., et al., "Development and Evaluation of SoySNP50K, a High Density Genotyping Array for Soybean," PLoSOne, Jan. 25, 2013, vol. 8 No. 1, p. e54985, 12 pages.
Sontheimer E.J., et al.,"Cas9 gets a classmate," Nature Biotechnology, Dec. 2015, vol. 33, No. 12, pp. 1240-1241.
Stemmer M., et al., "CCTop: An Intuitive, Flexible and Reliable CRISPR/Cas9 Target Prediction Tool," PLoS One, Apr. 24, 2015, vol. 10, No. 4, e0124633, 11 Pages.
Strecker J., et al., "Engineering of CRISPR-Cas12b for Human Genome Editing," Nature Communications, 2019, vol. 10, Article No. 212, Retrieved from URL: https://doi.org/10.1038/s41467-018-08224-4.
Stryer L., et al., "A Nucleic Acid Consists of Four Kinds of Bases Linked to a SugarPhosphate Backbone", Stryer's Biochemistry, Sixth Edition, 2002, pp. 108-109, XP055688354.
Subburaj S., et al., "Site-Directed Mutagenesis in Petunia ×Hybrida Protoplast System Using Direct Delivery of Purified Recombinant Cas9 Ribonucleoproteins," Plant Cell Reports, 2016, vol. 35, pp. 1535-1544.
Sun Z., et al., "Expanding the Biotechnology Potential of Lactobacilli Through Comparative Genomics of 213 Strains and Associated Genera," Nature Communications, Nature Publishing Group, UK, Sep. 29, 2015, vol. 6, Article No. 8322, 13 Pages.
Svitashev S., et al., "Genome Editing in Maize Directed by CRISPR-Cas9 Ribonucleoprotein Complexes," Nature Communications, Nov. 16, 2016, vol. 07, Article No. 13274, 7 Pages, DOI: 10.1038/ncomms13274, PMID: 27848933, PMCID: PMC5116081.
Tang X., et al: "A CRISPR-Cpf1 System for Efficient Genome Editing and Transcriptional Repression in Plants, " Nature Plants, 2017, vol. 3, Article No. 17018, 16 Pages.
UniProt: RecName: "Full-CRISPR-Associated Endonuclease Cas9," Database Accession No. HOUDA8, 2012, Retrieved from URL: EBI.
UniProt: "Uncharacterized Protein from *Sulfurospirillum* sp. SCADC," UniParc, Database Accession No. A0A087MA12, 2014, 01 Page.
UniProtKB: Database Accession No. A0A1Q3MN31_9BACT, Apr. 21, 2017, 5 pages, URL: UniProt, XP055851007.
Unniyampurath U., et al., "RNA Interference in the Age of CRISPR: Will CRISPR Interfere with RNAi," International Journal of Molecular Sciences, Feb. 26, 2016, vol. 17, No. 291, 15 Pages.
Wang M., et al., "Multiplex Gene Editing in Rice Using the CRISPR-Cpf1 System," Molecular Plant, 2017, vol. 10, No. 7, pp. 1-3.
Wang Q., et al., "PAM-Interacting Domain Swapping is Extensively Utilized in Nature to Evolve CRISPR-Cas9 Nucleases With Altered PAM Specificities," BioRxiv, May 1, 2021, pp. 1-27, DOI:10.1101/2021.05.01.442224, XP055854284, Oct. 25, 2021, Retrieved from URL: https://www.biorxiv.org/content/10.1101/2021.05.01.442224v1.full.pdf.
Wei F., et al., "Physical and Genetic Structure of the Maize Genome Reflects Its Complex Evolutionary History," PLoS Genetics, Jul. 20, 2007, vol. 3, No. 7, pp. 1254-1263.
Wierzbicki A.T., et al., "Noncoding Transcription by RNA Polymerase Pol IVb/Pol V Mediates Transcriptional Silencing of Overlapping and Adjacent Genes," Cell, Nov. 14, 2008, vol. 135, pp. 635-648.
Wolter F., et al., "Knocking Out Consumer Concerns and Regulators Rules: Efficient Use of CRISPR/Cas Ribonucleoproteir Complexes for Genome Editing in Cereals," Genome Biology, 2017, vol. 18, No. 43, 3 Pages.
Xiang G., et al., "Temperature Effect on CRISPR-Cas9 Mediated Genome Editing," Journal of Genetics Genomics, 2017, vol. 44, pp. 199-205.
Xu L., et al., "Empower Multiplex Cell and Tissue-Specific CRISPR-Mediated Gene Manipulation with Self-Cleaving Ribozymes and tRNA," Nucleic Acids Research, 2016, vol. 45, No. 5(e28), 9 Pages.
Yan W.X., et al., "Functionally Diverse Type V CRISPR-Cas Systems," Science, Jan. 4, 2019, vol. 363, pp. 88-91, 5 Pages.
Yao X., et al., "Homology-Mediated End Joining-Based Targeted Integration Using CRISPR/Cas9," Cell Research, Jun. 2017, vol. 27, No. 6, pp. 801-814.
Yin H., et al., "Partial DNA-Guided Cas9 Enables Genome Editing with Reduced Off-Target Activity," Nature Chemical Biology, Mar. 2018, vol. 14, pp. 311-317, 10 Pages, (and Life Sciences Reporting Summary).
Yin X., et al., "CRISPR-Cas9 and CRISPR-Cpf1 Mediated Targeting of a Stomatal Developmental Gene EPFL9 in Rice," Plant Cell Reports, 2017, vol. 36, pp. 745-757.
Zhang J-P., et al., "Efficient Precise Knockin with a Double Cut HDR Donor After CRISPR/Cas9-Mediated Double-Stranded DNA Cleavage," Genome Biology, 2017, vol. 18, No. 35, pp. 1-18.
Zhao Y., et al., "An Alternative Strategy for Targeted Gene Replacement in Plants Using a Dual-sgRNA/Cas9 design," Nature Scientific Reports, 2016, vol. 6, p. 23890, 11 pages.

* cited by examiner

FIG. 3

|   | ID2 | ID3 | ID4 | ID5 | ID6 | ID8 | ID9 | ID84 | ID83 | ID104 | | | |
|---|---|---|---|---|---|---|---|---|---|---|---|---|---|
| I | NAR(G>A)W H(A>T>C)GN R(G>A)TTTN (C>T>R) | N(C>D)V(A>S) (T>V) | NV(A>G>C)T TTTT | NATTTTT | NN(H>G)AA AN(G>A>Y)N | N(T>V)NAAA TN | NAV(A>G>C) TCNN | NAAANACN | BGD(G>W)G TCN(A>K>C) | NAR N(T>M>G)CC N | | | |
| II | NN(A>S>T)N N(W>G>C)CC N(Y>R) | ID13 | ID103 | ID105 | | | | | | | | | |
|  | NNAH(T>M) ACN | NAGNGCN | NATCCTN | | | | | | | | | | |
| III | ID16 | ID17 | ID18 | ID19 | ID21 | ID91 | ID93 | ID98 | ID139 | ID101 | | | |
|  | NGTGANN | NARN (A>K>C)ATN | NV(G>A>C)R NTTN | NN(A>B)RN (A>G>T>C)CC | | NMR N(A>Y>G)A | NNNCACN | NGCNGCN | NARN(T>A>S) ACN | NNNCATN | | | |
| IV | | | | | | | | | | | | | |
| V | ID27 | ID28 | ID29 | ID30 | ID32 | ID33 | ID35 | ID43 | ID41 | ID44 | ID85 | ID88 | ID96 |
|  | NN(A>B)NN (T>V)CCH (A>Y) | NNN(H>G)N CDAA | NN(H>G)D (A>K)GGDN (A>B) | NMMNCCA G | NMNNCTAA | NNNNCVG ANN | N(C>D)NNT CCN | NNNNCTA | N/A | NNNNCYAA | NRTHA N(A>B)N | BHN(H>G)N GN(T>M) H(Y>A) | NNNNATW |
| VI | ID46 NAGRGNY | | | | | | | | | | | | |
| VII | ID47 | ID48 | ID50 | ID51 | ID52 | ID56 | ID60 | ID61 | ID116 | ID122 | ID124 | ID125 | ID126 |
|  | NNNGH(W>C) AAA | NNGAAAN | NNAAAAA | NTGAR(G>A) N(A>Y>G)N (Y>R) | N(C>D)H (C>W)GH (Y>A)N(A>B)A N(A>T>S) | NNAAACN | NNGTAM (A>C)Y | NH(A>Y)ARN N(C>W>G)N | NNGAD (G>W)NN | NNAAAGN | NNAGAAA | NN(T>M>G)A AAAA | N(C>D) N(C>W>G)G W(T>C) D(A>G>T)AA |
| VIII | ID63 B(C>K)GG N(A>Y>G)NN | ID107 N(C>T>G>A)A AD(A>G>T)C | ID108 NAAAGNN | | | | | | | | | | |
| IX | ID64 N(T>C>R)AG AN(A>K>C)N | ID65 NGGN (A>T>G>C)NN | ID66 NGGD (A>T>G)TNN | ID67 NGGA N(T>A>C>G)N | ID68 CGGWN (T>R>C)NN | ID70 NGGWGNN | ID71 N(B>A)GGN N(T>V)NN | ID119 NGGN(W>S) NNN | ID120 N(T>V)GG D(W>G)GNN | ID121 NGG D(A>T>G) | ID123 N(G>H)GGD N(T>M>G)NN | ID131 NRGNNNN | ID136 NNDATTT |
| X | ID77 NNGD (A>T>G)AY (T>C)N | ID78 N(T>V) H(T>C>A)A AN | ID79 NRTAANN | ID80 N(H>G)CAA N(Y>A)N(Y>R) N | ID81 NATAAN (A>T>S) | ID87 NV(A>G>C) (A>G)ACCN | ID109 NNGACNN | ID112 N(T>V)NTAA D(A>T>G)N | | ID127 NAAAAYN | ID132 NATGN (H>G)TN | ID138 NATARC N(C>T>A>G) | |
| XI | ID94 CN(C>W>G)A V(A>S)GAC | ID97 | NNRNCAC | | | | | | | | | | |
| XII | ID102 N(A>B)GGD (W>G)D(G>W) NN | | | | | | | | | | | | |

FIG. 4

```
   (1) ----------YILGLDIGI-SVGWAIIE-----------------IID-G
  (51) VRLF--AE--K---S---N--RR-AR--RRLIRRR--RL-RLKRLL---G
 (101) LL---------------------------------------------W-LRG
 (151) -ALD--LE--ELA-VLLHL-KRRGF-S----E----D-E--------I--N
 (201) -------------RTVGEI-L-R---------------------------
 (251) ------------------Y---F-R--L--EL--IL--QR-Y-------E
 (301) -IE--I--I--KR-------------------------------------
 (351) -----LVGKCTF---------PDE-RA-KASYTAE-F-LL--LNNLRI--
 (401) ---------------------------------I--K-IRKLL-L--E-I
 (451) ---L---K---------------------L-AY--IK--L----------
 (501) ----------EILDEIA-ILTL-KE-E-I---LK-----------------
 (551) ------L---------F--F--LSLKAL--ILP-L--G-------------
 (601) --------------------------------------------------
 (651) --------I---I-----------------------D-I-NPVV-RAL-QA
 (701) RKVINAIIKKYG---P--IVIELARDL-NS-D-RK-I-K-QKEN------
 (751) A-E-L-E----------------------LKLRLW-EQ--------GKCLYSG
 (801) --I-I--LL--------------EIDHILP-SRSFDDS--NKVLV---EN
 (851) Q--KGNRTPYEYF---------W--F---V------------------KK-
 (901) -------I---E--K-FI-RNLNDTRYISR-V-NFL---F----------
 (951) ------------------KV-TV-G-LTA-LR-KWGL-K-R-E--------
(1001) ------H-HHALDALIVA-ST---I-KIS-------E--------------
(1051) --------------------P---FREEV---------------------
(1101) -------------------V------SRV-------T-------------
(1151) -----------------------------I-L---D----LM---D---YE
(1201) -I--II--Y---------------------------------L-K-S
(1251) K-G-----I---K----KL---I-I---------------VV-----M
(1301) VRIDVY----------LV-V----V--------L----------------
(1351) --I-----------------------F-FSLYK-DLI-I-----------
(1401) ------------------------------Y----D-S-----L----
(1451) ----------------K------------------I-KY-VDVLG--Y-V-
(1501) -E-----------------------
```

FIG. 5

```
   (1) ---------------Y-LGLDIGTNSVGWAVV-D-Y-V------I--LG-
  (51) -------K---G--LFDSG-TAADRR--RTARRRL-RRK-RI--L-EIFA
 (101) --M--VD--FF-RL-ES-----D-----------------EE--YH--
 (151) YPTIYHLRK-LM----K-DLRLIYLAL-HIIK-RG-FL-E----------
 (201) --L----------F----------E---------------I----I--E-
 (251) --K--K----I----------------------------L---V------K-
 (301) ---------------D--EE-LE-LL--I-D----DL-L-A--LY-AILLS-
 (351) IL-V--------LS-S-V-RYD-H--DL--LK--IK-----D-Y--IF--
 (401) --K--------------------------EEFYK-LK--L---------
 (451) --------L--I----FL-KQRT--NG-IPHQL-L-ELKAII--Q--YY-
 (501) FL-----E----------KI--IL-FRIPYYVGPL-------------FAW
 (551) --RK------------I-PWNFEE-VD---SA--FI-RMT-KD-YL--E-
 (601) VLPK-SLLYE-F-VYNEL--VR---E----------I----K--IFD-LF-
 (651) --RKVT-K-L---L-----------I-GIE-------F-SSL-TY-DL---
 (701) I-----------L---------LE-II---TLFED-E----MI--KL----
 (751) -------I--L----Y-GWGRLS-KLI--I------------L-------
 (801) ----------------MQLI--D---F------A-------------D
 (851) -LE-LV--L--SPAVKKGI-QSLKVV-EIVKI-G-------P--I-IEMA
 (901) RE----TA---R-----RI--L--------------------------
 (951) ----------------------------------------L--DKLYLYYLQ
(1001) NG-KDMYTG--IDID-L------YDIDHIIPQS-IKDDSIDNKVL--S--
(1051) N--K-D-VP-D-IV----------------M---W--L----LISK-KY
(1101) --L-K------LT--DKAGFI-RQLVETRQITK-VA-IL----F--------
(1151) --------------------D--IV-VKS-LVS-FRK-F-L-KVR------
(1201) -----------------------EIN--HHA-DAYL-AVVG---I--Y-
(1251) -L---FVYG-Y------K--------------------M--F-N---
(1301) ------ILV-----------------W------L--V-KV-------M
(1351) ---KK--------L--------TI-------------LI-R----------
(1401) YGG--S----------------------------VAY--LV--D-
(1451) -K--------V----I--IL---L-E-------E-------L--K-------
(1501) ----I-L-K-SL------G-----V--------------GN-L-L--------
(1551) -Y------------------------------------V------L--
(1601) I---I---------L-------I--I------------------I---
(1651) -I-L------SL---A------------R-TSL-E---------------
(1701) -------A-LIHQSITGLYE-KIRL--LG------------------
```

FIG. 6

```
   (1) -----L---K-YRVGIDVGTHSVGLAAIEVDDH--------PI-ILSALS
  (51) LIHDSGVDPD--K-A-TRKA-SGVARRTRRLHK-RR-RL-KLDEVLNDLG
 (101) FPI-----F-D----SDPYI-WNVRAKLVE-FIPDD--RG--ISIAIRHI
 (151) ARHRGWRNPYSKV-SL-SPA--S---------------------------
 (201) ---------------E-IR--II----GD-L--GITIGQLI--A-I----KIR
 (251) RD------------IISAKLHQSDHA-EI--I--RQ-VD-DL-KQLLDAV
 (301) F-ADSP--KGAAL-RVGKDPL-----F-RA-KATPAFQRYRIIAIIANLR
 (351) IRET-GE-RLTTDDRRKIFD-IL-LPS--D--------LTWLDVAE-LGI
 (401) -R-DLRGTASLTDDGERSAAKPPV-DTNR-ILQSKI-PL--WW--ANSDE
 (451) R-AMIKFLSNA----D--D-D-P-DAEIA-IIAEL-E-D-DKLDSLHLPA
 (501) GRAAYS-DTL--LTDHML-T--DLHEAR--LF-VAK-WAPPAP-I-EPVG
 (551) NPSVDRTLKIIARWL-AM---WG-PESI-IEHVRDGFSSEA-A-E-DRDN
 (601) -RRYNDN-ELL-KIQ---G-EG--SRADI-RI-ALQRQNC-CIYCG-TIT
 (651) F-TCQMDHIVPRAGPGS-NKRDNLVAVC-RCNKSKSNTPFAVWAK---IP
 (701) -V-LKEAL-RIR-W-KDT--MSSKDF-RFK--VIARLKRT--DEPLDNRS
 (751) MESVAWMANELR-RIAA-YGEH----------KV-VYRGSITAAAR---
 (801) ----------AAGIDSKL-FIDG-G-KSRLDRRHHAVDASVIALM---VA
 (851) KILAERSSIR-E------------L-KK-D-WRNFTGSTDA-RE-F--W
 (901) -A---M--LTDLLN-KLAEDKI-VT-NIRLRLGNG-AH-DTI--LMS-RV
 (951) GDALSVT-IDRA-T-ALWCALTRD-DFD-K-GLPANP-RRIRVHG-WFDA
(1001) DDHI-VF--A-----------------------GAI-VRGGFAEIG-SI
(1051) HH-RFYKI-GKKP-------IYAMLRVFT-DL-A--------R--DLFSL
(1101) -IPPQSISMR-AEPKLRKAI-DGNAEYLGWIVVDDELEI---SF------
(1151) -------IARLL-DFP-T-RWRI-GF-SNSKL-LRPIQLAAEGL---ASA
(1201) --R-------IVD--GWR-AIN-LLSALHLTVIRR-ALG-LR--SNSNLPT
(1251) SWKID----
```

*Spacer and PAM shifted by 3nt

FIG. 9A

Protospacer Position

| Clade | ID No. | 1 | 2 | 3 | 4 | 5 | 6 | 7 | 8 | 9 | 10 | 11 | 12 | 13 | 14 | 15 | 16 | 17 | 18 | 19 |
|---|---|---|---|---|---|---|---|---|---|---|---|---|---|---|---|---|---|---|---|---|
| I | ID2 | PAM | | 18.75 | | | | | | | | | | | | | | | | |
| I | ID3 | PAM | | 5.23 | | | | | | | | | | | | | | | | |
| I | ID4 | PAM | | 56.28 | | | | | | | | | | | | | | | | |
| I | ID5 | PAM | | 23.33 | | | | | | | | | | | | | | | | |
| I | ID6 | PAM | | 32.99 | | | 4.19 | | | | | | | | | | | | | |
| I | ID8 | PAM | | 48.60 | | | 3.63 | | | | | | | | | | | | | |
| I | ID9 | PAM | | 14.87 | | | 6.67 | 4.59 | | | | | | | | | | | | |
| I | ID83 | PAM | | 37.90 | | | | | | | | | | | | | | | | |
| I | ID84 | PAM | | 21.67 | | | | | | | | | | | | | | | | |
| I | ID104 | PAM | | 47.98 | | | | | | | | | | | | | | | | |
| III | ID12 | PAM | | 55.81 | | 5.11 | | | 3.68 | | | | | | | | | | | |
| III | ID13 | PAM | | 38.18 | | | | | | | | | | | | | | | | |
| III | ID103 | PAM | | 54.37 | | 4.97 | | | | | | | | | | | | | | |
| III | ID105 | PAM | | 55.47 | | | | | | | | | | | | | | | | |
| III | ID16 | PAM | | 11.76 | | | | | | | | | | | | | | | | |
| III | ID17 | PAM | | 44.00 | | | 6.34 | | | | | | | | | | | | | |
| III | ID18 | PAM | | 4.25 | | | | | | | | | | | | | | | | |
| III | ID19 | PAM | | 72.66 | | | | | | | | | | | | | | | | |
| III | ID91 | PAM | | 61.40 | | | 5.32 | 12.48 | | | | | | | | | | | | |
| III | ID93 | PAM | | 19.15 | | | | | 3.65 | | | | | | | | 3.35 | | | |
| III | ID94 | PAM | | 32.00 | | | | | | | | | | | | | | | | |
| III | ID98 | PAM | | 25.20 | | | | | | | | | | | | | | | | |
| III | ID101 | PAM | | 40.98 | | | | | | | | | | | | | | | | |
| V | ID27 | PAM | 3.54 | 59.00 | | | | | | | | | | | | | | | | |
| V | ID28 | PAM | | 76.36 | | | | | | | | | | | | | | | | |
| V | ID29 | PAM | 3.18 | 24.43 | | | | | | | | | | | | | | | | |
| V | ID30 | PAM | | 32.59 | | | | | | | | | | | | | | | | |
| V | ID32 | PAM | | 27.12 | | | | | | | | | | | | | | | | |
| V | ID33 | PAM | | 76.82 | | | | | | | | | | | | | | | | |
| V | ID35 | PAM | | 43.46 | | | | | | | | | | | | | | | | |
| V | ID41 | PAM | | 50.59 | | 4.30 | | | | | | | | | | | | | | |
| V | ID44 | PAM | | 18.47 | | | | | | | | | | | | | | | | |
| V | ID85 | PAM | | 28.04 | | | | | | | | | | | | | | | | |
| V | ID88 | PAM | | 18.61 | | | | | | | | | | | | | | | | |
| V | ID96 | PAM | | 28.74 | | | | | | | | | | | | | | | | |

FIG. 9B

Protospacer Position

| Clade | ID No. | 19 | 18 | 17 | 16 | 15 | 14 | 13 | 12 | 11 | 10 | 9 | 8 | 7 | 6 | 5 | 4 | 3 | 2 | 1 |
|---|---|---|---|---|---|---|---|---|---|---|---|---|---|---|---|---|---|---|---|---|
| VI | ID46 | | | | | | | | | | | | 4.06 | 6.75 | 30.62 | 6.90 | | | | PAM |
| VII | ID47 | | | | | | | | | | 3.07 | | | | | | 26.01 | | | PAM |
| VII | ID48 | | | | | | | | | | 3.19 | | | | | | 27.18 | | | PAM |
| VII | ID50 | | | | | | | | | | | | | | | | 19.66 | | | PAM |
| VII | ID51 | | | | | | | | | | | | | | 3.43 | | 31.30 | | | PAM |
| VII | ID52 | | | | | | | | | | | | | | | | 69.26 | | 3.83 | PAM |
| VII | ID56 | | | | | | | | | | | | | | | | 67.57 | | 5.11 | PAM |
| VII | ID60 | | | | | | | | | | | | | | | | 17.05 | | | PAM |
| VII | ID61 | | | | | | | | | | | | | | | | 45.25 | | | PAM |
| VII | ID116 | | | | | | | | | | | | | | | | 41.85 | | | PAM |
| VII | ID122 | | | | | | | | | | | | | | | | 44.57 | | | PAM |
| VII | ID124 | | | | | | | | | | | | | | | | 18.47 | | | PAM |
| VII | ID125 | | | | | | | | | | | | | | | | 31.50 | | | PAM |
| VII | ID126 | | | | | | | | | | | | | | | | 19.19 | | | PAM |
| VIII | ID63 | | | | | | | | | | | | | 12.41 | 4.52 | 8.12 | | | | PAM |
| VIII | ID107 | | | | | | | | | | | | | | | 9.55 | 38.22 | | | PAM |
| VIII | ID108 | | | | | | | | | | | | | | | 49.65 | | | | PAM |
| IX | ID64 | | | | | | | | | | | | | | 7.09 | | 44.96 | | | PAM |
| IX | ID65 | | | | | | | | | | | | | | 5.06 | 6.74 | 13.03 | | | PAM |
| IX | ID66 | | | | | | | | | | | | | | 3.57 | 6.57 | 27.04 | | | PAM |
| IX | ID67 | | | | | | | | | | | | | | 3.53 | 3.69 | 28.18 | | | PAM |
| IX | ID68 | | | | | | | | | | | | | | | 16.65 | 8.75 | | | PAM |
| IX | ID70 | | | | | | | | | | | | | | 24.89 | 15.14 | 6.02 | | | PAM |
| IX | ID71 | | | | | | | | | | | | | | | 15.72 | 16.17 | | | PAM |
| IX | ID119 | | | | | | | | | | | | | | | 40.91 | 26.96 | | | PAM |
| IX | ID131 | | | | | | | | | | | | | | | 34.76 | 28.63 | | | PAM |
| IX | ID120 | | | | | | | | | | | | | | | 7.56 | 19.61 | | | PAM |
| IX | ID121 | | | | | | | | | | 4.60 | | | | | 20.62 | 35.37 | | | PAM |
| IX | ID123 | | | | | | | | | | | | | 4.67 | 21.81 | 21.79 | 30.57 | | | PAM |
| IX | ID136 | | | | | | | | | | | | | | | | 56.20 | | | PAM |

FIG. 9C

Protospacer Position

| Clade | ID No. | 1 | 2 | 3 | 4 | 5 | 6 | 7 | 8 | 9 | 10 | 11 | 12 | 13 | 14 | 15 | 16 | 17 | 18 | 19 |
|---|---|---|---|---|---|---|---|---|---|---|---|---|---|---|---|---|---|---|---|---|
| X | ID77 | PAM | | | 44.44 | | | | | | | | | | | | | | | |
| X | ID78 | PAM | | | 16.43 | | | | | | | | | | | | | | | |
| X | ID79 | PAM | | | 35.15 | | | | | | | | | | | | | | | |
| X | ID80 | PAM | | | 31.40 | | | | | | | | | | | | | | | |
| X | ID81 | PAM | | | 65.39 | | | | | | | | | | | | | | | |
| X | ID87 | PAM | | | 37.69 | 5.32 | | | | | | | | | | | | | | |
| X | ID106 | PAM | | | 35.14 | | | | | | | | | | | | | | | |
| X | ID109 | PAM | | | 32.35 | 10.43 | | | | | | | | | | | | | | |
| X | ID112 | PAM | | | 19.51 | | | | | | | | | | | | | | | |
| X | ID127 | PAM | | | 20.17 | | | | | | | | | | | | | | | |
| X | ID132 | PAM | | | 27.74 | 5.04 | | | | | | | | | | | | | | |
| X | ID138 | PAM | | | 23.64 | | | | | | | | | | | | | | | |
| XI | ID94 | PAM | | | 21.76 | | | | | | | | | | | | | 3.80 | | |
| XI | ID97 | PAM | | | 59.70 | | | | | | | | | | | | | | | |
| XII | ID102 | PAM | | | | 29.26 | 6.35 | 15.99 | 4.40 | | | | 3.18 | | | | | 8.05 | | |

FIG. 15A

Expected Cut-Site / gRNA Target / PAM

| | SEQ ID NO: | Read Count | 30X Greater Frequency than in Wt Control |
|---|---|---|---|
| Wt Reference | 1746 | 1347355 | |
| Mutant 1 | 1747 | 3267 | Yes |
| Mutant 2 | 1748 | 2320 | Yes |
| Mutant 3 | 1749 | 1859 | Yes |
| Mutant 4 | 1750 | 753 | Yes |
| Mutant 5 | 1751 | 169 | Yes |
| Mutant 6 | 1752 | 163 | Yes |
| Mutant 7 | 1753 | 156 | Yes |
| Mutant 8 | 1754 | 131 | Yes |
| Mutant 9 | 1755 | 98 | Yes |
| Mutant 10 | 1756 | 75 | Yes |
| Mutant 11 | 1757 | 70 | Yes |
| Mutant 12 | 1758 | 65 | Yes |
| Mutant 13 | 1759 | 63 | Yes |
| Mutant 14 | 1760 | 61 | Yes |
| Mutant 15 | 1761 | 54 | Yes |
| Mutant 16 | 1762 | 50 | Yes |
| Mutant 17 | 1763 | 49 | Yes |
| Mutant 18 | 1764 | 42 | Yes |
| Mutant 19 | 1765 | 41 | Yes |
| Mutant 20 | 1766 | 41 | Yes |

FIG. 15B

Expected Cut-Site / PAM / gRNA Target

| | SEQ ID NO: | Read Count | 30X Greater Frequency than in Wt Control |
|---|---|---|---|
| Wt Reference | 1767 | 2011981 | |
| Mutant 1 | 1768 | 1751 | Yes |
| Mutant 2 | 1769 | 1002 | Yes |
| Mutant 3 | 1770 | 664 | Yes |
| Mutant 4 | 1771 | 651 | Yes |
| Mutant 5 | 1772 | 537 | Yes |
| Mutant 6 | 1773 | 443 | Yes |
| Mutant 7 | 1774 | 387 | Yes |
| Mutant 8 | 1775 | 296 | Yes |
| Mutant 9 | 1776 | 289 | Yes |
| Mutant 10 | 1777 | 261 | Yes |
| Mutant 11 | 1778 | 249 | Yes |
| Mutant 12 | 1779 | 246 | Yes |
| Mutant 13 | 1780 | 237 | Yes |
| Mutant 14 | 1781 | 223 | Yes |
| Mutant 15 | 1782 | 200 | Yes |
| Mutant 16 | 1783 | 181 | Yes |
| Mutant 17 | 1784 | 180 | Yes |
| Mutant 18 | 1785 | 180 | Yes |
| Mutant 19 | 1786 | 168 | Yes |
| Mutant 20 | 1787 | 166 | Yes |

*Based on absence of wildtype reads

FIG. 19A

| | Sequence | SEQ ID NO: | Read Count | 30X Greater Frequency than in Wt Control |
|---|---|---|---|---|
| Wt Reference | GTAATCGAACTGTGGGTTCCTGCCACGTTCAGAATGTCTTGGACTCAAGTGTAAATGTACAGGGTTCAGTTTTGTAATA | 1788 | 1634878 | |
| Mutant 1 | GTAATCGAACTGTGGGTTCCTGCCACGTTCAGAATGTCTTGGACTCAAGTGTAAAtTGTACAGGGTTCAGTTTTGTAAT | 1789 | 592006 | Yes |
| Mutant 2 | GTAATCGAACTGTGGGTTCCTGCCACGTTCAGAATGTCTTGGACTCAAGTGTAAATatGTACAGGGTTCAGTTTTGTAA | 1790 | 118154 | Yes |
| Mutant 3 | GTAATCGAACTGTGGGTTCCTGCCACGTTCAGAATGTCTTGGACTCAAGT------GTACAGGGTTCAGTTTTGTAATA | 1791 | 36875 | Yes |
| Mutant 4 | GTAATCGAACTGTGGGTTCCTGCCACGTTCAGAATGTCTTGGACTCAAGTGTAA-TGTACAGGGTTCAGTTTTGTAATA | 1792 | 23793 | Yes |
| Mutant 5 | GTAATCGAACTGTGGGTTCCTGCCACGTTCAGAATGTCTTGGACTCAAGTGTAAAaTGTACAGGGTTCAGTTTTGTAAT | 1793 | 15600 | Yes |
| Mutant 6 | GTAATCGAACTGTGGGTTCCTGCCACGTTCAGAATGTCTTGGACTCAAGTGTAAA--TACAGGGTTCAGTTTTGTAATA | 1794 | 15433 | Yes |
| Mutant 7 | GTAATCGAACTGTGGGTTCCTGCCACGTTCAGAATGTCTTGGACTCAAGTGTAAATtgTACAGGGTTCAGTTTTGTAA | 1795 | 13284 | Yes |
| Mutant 8 | GTAATCGAACTGTGGGTTCCTGCCACGTTCAGAATGTCTTGGACTCAAGTGTAAATtgTACAGGGTTCAGTTTTGTAAT | 1796 | 11183 | Yes |
| Mutant 9 | GTAATCGAACTGTGGGTTCCTGCCACGTTCAGAATGTCTTGGACTCAAGTGT--ATGTACAGGGTTCAGTTTTGTAATA | 1797 | 8611 | Yes |
| Mutant 10 | GTAATCGAACTGTGGGTTCCTGCCACGTTCAGAATGTCTTGGACTC-------AATGTACAGGGTTCAGTTTTGTAATA | 1798 | 8062 | Yes |
| Mutant 11 | GTAATCGAACTGTGGGTTCCTGCCACGTTCAGAATGTCTTGGACTCAAGTGTAAATGTACCGG--------------- | 1799 | 6234 | Yes |
| Mutant 12 | GTAATCGAACTGTGGGTTCCTGCCACGTTCAGAATGTCTTGGACTCAAGTGTAAATtttACAGGGTCCAGTTTT----- | 1800 | 5500 | Yes |
| Mutant 13 | GTAATCGAACTGTGGGTTCCTGCCACGTTCAGAATGTCTTGGACTCAAGTG----TGTACAGGGTTCAGTTTTGTAATA | 1801 | 5050 | Yes |
| Mutant 14 | GTAATCGAACTGTGGGTTCCTGCCACGTTCAGAATGTCTTGGACTC---------TGTACAGGGTTCAGTTTTGTAATA | 1802 | 4650 | Yes |
| Mutant 15 | GTAATCGAACTGTGGGTTCCTGCCACGTTCAGAATGTCTTGGACTCAAGTGTAAAT---CAGGGTTCAGTTTTGTAATA | 1803 | 4426 | Yes |
| Mutant 16 | GTAATCGAACTGTGGGTTCCTGCCACGTTCAGAATGTCTTGGACTCAAGTGTAAATGtgTACAGGGTTCAGTTTTGTAA | 1804 | 4402 | Yes |
| Mutant 17 | GTAATCGAACTGTGGGTTCCTGCCACGTTCAGAATGTCTTGGACTCAAGTGTAAAT-aaaaaaattgtgatctgtaaa | 1805 | 4285 | Yes |
| Mutant 18 | GTAATCGAACTGTGGGTTCCTGCCACGTTCAGAATGTCTTGGACTCAAGTGTAAAtagTGTACAGGGTTCAGTTTTGTA | 1806 | 4249 | Yes |
| Mutant 19 | GTAATCGAACTGTGGGTTCCTGCCACGTTCAGAATGTCTTGGACTCAAGTGTA--GTACAGGGTTCAGTTTTGTAATA | 1807 | 3962 | Yes |
| Mutant 20 | GTAATCGAACTGTGGGTTCCTGCCACGTTCAGAATGTCTTGGACTCAAGTGTAAAT-TACAGGGTTCAGTTTTGTAATA | 1808 | 3776 | Yes |

FIG. 19B

| | Sequence | SEQ ID NO: | Read Count | 30X Greater Frequency than in Wt Control |
|---|---|---|---|---|
| Wt Reference | CCCAGAGGTATCCAGCAGAGGGGAGAAGAAAGAGAGATGTAGGGCTAGAGGGTGAGGCTGAAACAGTGACCTGTCTTG | 1809 | 106965 | |
| Mutant 1 | CCCAGAGGTATCCAGCAGAGGGGAGAAGAAAGAGAGATGTAGGGCTAGAGGGTGA-aaaaaaccccagtcgaggct | 1810 | 4349 | Yes |
| Mutant 2 | CCCAGAGGTATCCAGCAGAGGGGAGAAGAAAGAGAGATGTAGGGCTAGAG------GGCTGAAACAGTGACCTGTCTTG | 1811 | 3168 | Yes |
| Mutant 3 | CCCAGAGGTATCCAGCAGAGGGGAGAAGAAAGAGAGATGTAGGGCTAGAGGGTG-GGCTGAAACAGTGACCTGTCTTG | 1812 | 3133 | Yes |
| Mutant 4 | CCCAGAGGTATCCAGCAGAGGGGAGAAGAAAGAGAGATGTAGGGCTAGAGGGTGAtGGCTGAAACAGTGACCTGTCTTG | 1813 | 3124 | Yes |
| Mutant 5 | CCCAGAGGTATCCAGCAGAGGGGAGAAGAAAGAGAGATGTAGGGCTAGAGGG------TGAAACAGTGACCTGTCTTG | 1814 | 2843 | Yes |
| Mutant 6 | CCCAGAGGTATCCAGCAGAGGGGAGAAGAAAGAGAGATGTAGGGCTAGAGGGTGAaGGCTGAAACAGTGACCTGTCTTG | 1815 | 2349 | Yes |
| Mutant 7 | CCCAGAGGTATCCAGCAGAGGGGAGAAGAAAGAGAGATGTAGGGCTAGAGGGTGAcGGCTGAAACAGTGACCTGTCTTG | 1816 | 1442 | Yes |
| Mutant 8 | CCCAGAGGTATCCAGCAGAGGGGAGAAGAAAGAGAGATGTAGGGCTAGAGGGTGA-aaaaagcccagtgagggcta | 1817 | 927 | Yes |
| Mutant 9 | CCCAGAGGTATCCAGCAGAGGGGAGAAGAAAGAGAGATGTAGGGCTAGAGGG--GGCTGAAACAGTGACCTGTCTTG | 1818 | 923 | Yes |
| Mutant 10 | CCCAGAGGTATCCAGCAGAGGGGAGAAGAAAGAGAGATGTAGGGCTAGAGGGTGA-aagtcttatgccgaaatcagcc | 1819 | 903 | Yes |
| Mutant 11 | CCCAGAGGTATCCAGCAGAGGGGAGAAGAAAGAGAGATGTAGGGCTAGAGGGTGA-GCTGAAACAGTGACCTGTCTTG | 1820 | 822 | Yes |
| Mutant 12 | CCCAGAGGTATCCAGCAGAGGGGAGAAGAAAGAGAGATGTAG---------------GGCTGAAACAGTGACCTGTCTTG | 1821 | 797 | Yes |
| Mutant 13 | CCCAGAGGTATCCAGCAGAGGGGAGAAGAAAGAGAGATGTAGGGCTAGAGG-------------GTGACCTGTCTTG | 1822 | 716 | Yes |
| Mutant 14 | CCCAGAGGTATCCAGCAGAGGGGAGAAGAAAGAGAGATGTAGGGCTAGA-------GGCTGAAACAGTGACCTGTCTTG | 1823 | 636 | Yes |
| Mutant 15 | CCCAGAGGTATCCAGCAGAGGGGAGAAGAAAGAGAGATGTAGGGCTAGAGGGTGA-atccacgccagcaatacccgaa | 1824 | 598 | Yes |
| Mutant 16 | CCCAGAGGTATCCAGCAGAGGGGAGAAGAAAGAGAGATGTAGGGCTAGAGGGTGAGGC-gttccccggagctgtgc | 1825 | 579 | Yes |
| Mutant 17 | CCCAGAGGTATCCAGCAGAGGGGAGAAGAAAGAGAGATGTAGGGCT---------GGCTGAAACAGTGACCTGTCTTG | 1826 | 548 | Yes |
| Mutant 18 | CCCAGAGGTATCCAGCAGAGGGGAGAAGAAAGAGAGATGTAGGGCTAGAGGGTGA-aaccggttcggctgacaatctgt | 1827 | 523 | Yes |
| Mutant 19 | CCCAGAGGTATCCAGCAGAGGGGAGAAGAAAGAGAGATGTAGGGCTAGAGGGTGA-ctgccgatggcgttgatggggct | 1828 | 506 | Yes |
| Mutant 20 | CCCAGAGGTATCCAGCAGAGGGGAGAAGAAAGAGAGATGTAGGGCTAGAGGGTGA-caacataccgggatgtgaagga | 1829 | 483 | Yes |

CAS9 ORTHOLOGS

CROSS-REFERENCE TO RELATED APPLICATIONS

This application claims the benefit of U.S. Provisional Application No. 62/634,257 filed on 23 Feb. 2018 and of U.S. Provisional Application No. 62/651,991 filed on 3 Apr. 2018, both of which are incorporated by reference herein in their entirety.

FIELD OF THE INVENTION

The disclosure relates to the field of molecular biology, in particular to compositions of guide polynucleotide/endonuclease systems, and compositions and methods for modifying a polynucleotide sequence, including the genome of a cell.

REFERENCE TO SEQUENCE LISTING SUBMITTED ELECTRONICALLY

The official copy of the sequence listing is submitted electronically via EFS-Web as an ASCII formatted sequence listing with a file named RTS26814AUSNP_SequenceListing_ST25.txt created on 21 Feb. 2019 and having a size of 8,870,696 bytes and is filed concurrently with the specification. The sequence listing comprised in this ASCII formatted document is part of the specification and is herein incorporated by reference in its entirety.

BACKGROUND

Recombinant DNA technology has made it possible to insert DNA sequences at targeted genomic locations and/or modify specific endogenous chromosomal sequences. Site-specific integration techniques, which employ site-specific recombination systems, as well as other types of recombination technologies, have been used to generate targeted insertions of genes of interest in a variety of organism. Genome-editing techniques such as zinc finger nucleases (ZFNs), transcription activator-like effector nucleases (TALENs), or homing meganucleases, are available for producing targeted genome perturbations, but these systems tend to have low specificity and employ nucleases that need to be redesigned for each target site, which renders them costly and time-consuming to prepare.

Newer technologies utilizing archaeal or bacterial adaptive immunity systems have been identified, called CRISPR (Clustered Regularly Interspaced Short Palindromic Repeats), which comprise different domains of effector proteins that encompass a variety of activities (DNA recognition, binding, and optionally cleavage).

Despite the identification and characterization of some of these systems, there remains a need for identifying novel effectors and systems, as well as demonstrating activity in eukaryotes, particularly animals and plants, to effect editing of endogenous and previously-introduced heterologous polynucleotides, as well as in vitro polynucleotide binding and/or modification. Most CRISPR gene editing is based almost entirely the Cas9 system derived from *Streptococcus pyogenes* (Barrangou and Doudna, 2016), which leaves a blunt-end overhang and effects gene editing via the recognition of a Protospacer Adjacent Motif (PAM) sequence of "NGG" on the target polynucleotide. A greater diversity of Cas9 proteins with different biophysical and biochemical characteristics, including different PAM recognition sequences, is desirable.

SUMMARY

Compositions and methods are provided for novel Cas polynucleotides and cas polypeptides.

In some aspects, the invention provides a synthetic composition comprising a heterologous component and a polynucleotide selected from the group consisting of: a polynucleotide sharing at least 80%, between 80% and 85%, at least 85%, between 85% and 90%, at least 90%, between 90% and 95%, at least 95%, at least 96%, at least 97%, at least 98%, at least 99%, at least 99.5%, or greater than 99.5% identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, between 500 and 550, at least 550, between 550 and 600, at least 600, between 600 and 650, at least 650, between 650 and 700, at least 700, between 700 and 750, at least 750, between 750 and 800, at least 800, between 800 and 850, at least 850, between 850 and 900, at least 900, between 900 and 950, at least 950, between 950 and 1000, at least 1000, or even than 1000 contiguous nucleotides of any of: SEQ ID NO:1-85, a functional variant of any of SEQ ID NO:1-85, a functional fragment of any of SEQ ID NO:1-85, a gene encoding a Cas endonuclease selected from the group consisting of: SEQ ID NO:86-171 and 511-1135, a gene encoding a Cas endonuclease that recognizes a PAM sequence listed in any of Tables 4-83, and a gene encoding a Cas endonuclease identified, derived, or isolated from an organism selected from the group consisting of *Acetobacter aceti, Acetobacter* sp. CAG:977, *Acholeplasma palmae, Acidaminococcus* sp., *Acidaminococcus_intestini*_RyC-MR95, *Acidothermus cellulolyticus, Acidovorax avenae, Acidovorax ebreus, Acidovorax* sp. MR-S7, *Actinobacillus capsulatus, Actinobacillus minor, Actinobacillus succinogenes, Actinobacillus suis, Actinomyces coleocanis, Actinomyces georgiae, Actinomyces meyeri, Actinomyces naeslundii, Actinomyces odontolyticus, Actinomyces* sp. ICM47, *Actinomyces* sp. oral taxon 175, *Actinomyces* sp. oral taxon 180, *Actinomyces* sp. oral taxon 181, *Actinomyces* sp. oral taxon 848, *Actinomyces* sp. S6-Spd3, *Afipia* sp. P52-10, *Akkermansia muciniphila, Alcanivorax pacificus, Alicycliphilus, Alicyclobacillus hesperidum, Aliiarcobacter faecis, Alistipes ihumii, Alistipes shahii, Alkaliflexus imshenetskii, Alloprevotella tannerae, Alloscardovia omnicolens, Alpha proteobacterium* AAP38, *Alpha proteobacterium* AAP81b, *Anaerococcus tetradius, Anaeromusa acidaminophila, Anoxybacillus* sp. P3H1B, *Aquabacterium parvum, Asinibacterium* sp. or53, *Azospirillum halopraeferens, Azospirillum* sp. B510, *Bacillus cereus, Bacillus cytotoxicus, Bacillus niameyensis, Bacillus okhensis, Bacillus pseudalcaliphilus, Bacillus smithii,* bacterium BRH_c32, bacterium LF-3, bacterium P3, *Bacteroidales bacterium* CF, *Bacteroides, Bacteroides coprophilus, Bacteroides coprosuis, Bacteroides faecis, Bacteroides fluxus, Bacteroides fragilis, Bacteroides pectinophilus, Bacteroides propionicifaciens, Bacteroides pyogenes, Bacteroides* sp. 14(A), *Bacteroides timonensis, Bacteroides vulgatus, Bacteroidetes* oral taxon 274, *Barnesiella viscericola, Bdellovibrio exovorus, Belliella baltica, Bibersteinia trehalosi, Bifidobacterium angulatum, Bifidobacterium bifidum, Bifidobacterium bombi, Bifidobacterium callitrichos, Bifidobacterium longum, Bifidobacterium* merycicum, *Bifidobacterium thermophilum, Bifidobacterium tsurumiense, Blastopirellula marina, Bordetella pseudohinzii, Brevibacillus laterosporus, Bryobacter aggregatus, Burkholderiales bacterium* GJ-E10, *Butyrivibrio hungatei, Butyrivibrio* sp. AC2005, *Butyrivibrio* sp. NC3005, *Caenispirillum salinarum, Campylobacter coli, Campylobacter jejuni, Campylobacter peloridis, Campylobacter subantarcticus*, candidate division TA06 bacterium 32_111, *Candidatus Brocadia sinica, Candidatus Hepatoplasma crinochetorum* Av, *Candidatus Micropelagos thuwalensis, Candidatus Symbiothrix dinenymphae, Capnocytophaga canis, Capnocytophaga cynodegmi, Capnocytophaga ochracea, Capnocytophaga* sp. CM59, *Capnocytophaga* sp. oral taxon 329, *Carnobacterium funditum, Carnobacterium gallinarum, Carnobacterium* sp. ZWU0011, *Caviibacter abscessus, Chitinophagaceae bacterium* PMP191F, *Chlamydia trachomatis, Chlorobi bacterium* NICIL-2, *Chryseobacterium gallinarum, Chryseobacterium indologenes, Chryseobacterium* sp. CF314, *Chryseobacterium* sp. ERMR1:04, *Chryseobacterium* sp. FH2, *Chryseobacterium* sp. Hurlbut01, *Chryseobacterium* sp. Leaf201, *Chryseobacterium* sp. Leaf394, *Chryseobacterium* sp. StRB126, *Chryseobacterium* sp. YR485, *Chryseobacterium tenax, Cloacibacillus evryensis, Clostridium beijerinckii, Clostridium botulinum, Clostridium perfringens, Clostridium* sp. CAG: 230, *Clostridium* sp. CAG: 433, *Clostridium spiroforme, Collinsella* sp. CAG:289, *Comamonadaceae bacterium* CCH4-05, *Comamonas granuli, Coprobacter fastidiosus, Coprobacter secundus, Coprococcus catus* GD/7, *Coriobacteriales bacterium* DNF00809, *Coriobacterium glomerans, Coriobacterium glomerans* PW2, *Corynebacterium, Corynebacterium accolens, Corynebacterium camporealensis, Corynebacterium caspium, Corynebacterium diphtherias, Corynebacterium falsenii, Corynebacterium lactis, Corynebacterium pseudodiphtheriticum, Corynebacterium vitaeruminis, Croceitalea dokdonensis, Cytophagales bacterium* B6, *Dechloromonas denitrificans, Defluviimonas, Demequina sediminicola, Desulfovibrio termitidis, Devosia* sp. Root635, *Dielma fastidiosa, Dinoroseobacter shibae, Dorea longicatena, Dysgonomonas* sp. HGC4, *Eggerthella_sp._YY7918, Eggerthella* sp. YY7918, *Eggerthellaceae bacterium* AT8, *Elizabethkingia anophelis, Elizabethkingia meningoseptica, Elusimicrobium minutum, Empedobacter brevis, Empedobacter falsenii, Endomicrobium proavitum, Enterococcus canis, Enterococcus cecorum, Enterococcus dispar, Enterococcus faecalis, Enterococcus faecalis* OG1RF, *Enterococcus faecium, Enterococcus hirae, Enterococcus italicus, Enterococcus massiliensis, Enterococcus mundtii, Enterococcus phoeniculicola, Enterococcus pseudoavium, Enterococcus thailandicus,* Environmental metagenome, *eubacterium dolichum, Eubacterium ramulus, Eubacterium rectale, Eubacterium* sp., *Eubacterium* sp. CAG:251, *Eubacterium ventriosum, Eubacterium yurii* subsp. *margaretiae* ATCC 43715, *Facklamia hominis, Fibrobacter succinogenes, Filifactor alocis, Finegoldia magna, Finegoldia_magna_ATCC_29328, Firmicutes bacterium* M10-2, *Flavobacterium akiainvivens, Flavobacterium branchiophilum, Flavobacterium columnare, Flavobacterium daejeonense, Flavobacterium filum, Flavobacterium frigidarium, Flavobacterium psychrophilum, Flavobacterium* sp. 83, *Flavobacterium* sp. ACAM 123, *Flavobacterium* sp. TAB 87, *Flavobacterium suncheonense, Fluviicola taffensis, Francisella hispaniensis, Francisella philomiragia, Francisella tularensis, Fructobacillus ficulneus, Fructobacillus fructosus, Fructobacillus* sp. EFB-N1, *Fusobacterium necrophorum, Fusobacterium nucleatum, Fusobacterium periodonticum, Galbibacter marinus, Gallibacterium anatis, gamma proteobacterium* HdN1, *Gamma proteobacterium* HTCC5015, *Gardnerella vaginalis, Gemella bergeri, Gemella cuniculi, Gemella haemolysans, Geobacillus* sp., *Globicatella sanguinis, Gluconacetobacter diazotrophicus, Gordonibacter pamelaeae, Granulicatella, Haemophilus, Haemophilus parainfluenzae, Haemophilus sputorum, Helcococcus sueciensis, Helicobacter apodemus, Helicobacter canadensis, Helicobacter cinaedi, Helicobacter fennelliae, Helicobacter muridarum, Helicobacter mustelae, Helicobacter pametensis, Helicobacter rodentium, Helicobacter typhlonius, Hugenholtzia roseola, Hyphomonas, Ignavibacterium album, Ilyobacter polytropus, Indibacter alkaliphilus, Jejuia pallidilutea, Jeotgalibaca dankookensis, Joostella marina, Kandleria vitulina, Kingella kingae, Kiritimatiella glycovorans, Kordia algicida, Kordia jejudonensis, Kurthia huakuii, Lachnobacterium bovis, Lachnospira multipara, Lachnospiraceae bacterium* AC2029, *Lachnospiraceae bacterium* MA2020, *Lachnospiraceae bacterium* NK4A179, *Lacinutrix jangbogonensis, Lactobacillus, Lactobacillus acidifarinae, Lactobacillus agilis, Lactobacillus animalis, Lactobacillus animalis* KCTC 3501, *Lactobacillus apodemi, Lactobacillus brevis, Lactobacillus buchneri, Lactobacillus cacaonum, Lactobacillus casei, Lactobacillus ceti, Lactobacillus ceti* DSM 22408, *Lactobacillus composti, Lactobacillus concavus, Lactobacillus coryniformis, Lactobacillus curvatus, Lactobacillus delbrueckii, Lactobacillus diolivorans, Lactobacillus farciminis, Lactobacillus fermentum, Lactobacillus floricola, Lactobacillus florum, Lactobacillus fuchuensis, Lactobacillus futsaii, Lactobacillus gastricus, Lactobacillus gorillae, Lactobacillus graminis, Lactobacillus hammesii, Lactobacillus heilongjiangensis, Lactobacillus hordei, Lactobacillus finers, Lactobacillus jensenii, Lactobacillus kefiri, Lactobacillus kunkeei, Lactobacillus lindneri, Lactobacillus mali, Lactobacillus melliventris, Lactobacillus mindensis, Lactobacillus mucosae, Lactobacillus namurensis, Lactobacillus nodensis, Lactobacillus oligofermentans, Lactobacillus otakiensis, Lactobacillus ozensis, Lactobacillus paracasei, Lactobacillus paracollinoides, Lactobacillus paragasseri, Lactobacillus pentosus, Lactobacillus plantarum, Lactobacillus psittaci, Lactobacillus rennini, Lactobacillus reuteri, Lactobacillus rhamnosus, Lactobacillus rossiae, Lactobacillus ruminis, Lactobacillus saerimneri, Lactobacillus sakei, Lactobacillus salivarius, Lactobacillus sanfranciscensis, Lactobacillus saniviri, Lactobacillus senmaizukei, Lactobacillus shenzhenensis, Lactobacillus* sp., *Lactobacillus* sp. wkB8, *Lactobacillus tucceti, Lactobacillus versmoldensis, Lactobacillus wasatchensis, Lactobacillus zymae, Lactobacillus_rhamnosus_LOCK900, Lagierella massiliensis, Lawsonella clevelandensis, Legionella pneumophila, Leptotrichia* sp. oral taxon 215, *Leuconostoc gelidum, Limnohabitans planktonicus, Listeria fleischmannii, Listeria ivanovii, Listeria monocytogenes, Listeria monocytogenes* Lm_1880, *Listeria seeligeri, Lunatimonas lonarensis, Lutibacter profundi, Mannheimia, Mannheimia massilioguelmaensis, Mannheimia* sp. USDA-ARS-USMARC-1261, *Massilibacterium senegalense, Megasphaera* sp. UPII 135-E, *Mesorhizobium* sp., *Mesorhizobium* sp. LC103, *Methylocystis* sp. ATCC 49242, *Methylophilus* sp. 5, *Methylophilus* sp. OH31, *Methylosinus, Methylovulum miyakonense, Mobiluncus curtisii, Mucilaginibacter paludis, Mucinivorans hirudinis, Mucispirillum schaedleri, Mycoplasma arginini, Mycoplasma canis, Mycoplasma dispar, Mycoplasma gallisepticum, Mycoplasma hyosynoviae, Mycoplasma mobile, Mycoplasma ovipneumoniae, Mycoplasma synoviae, Mycoplasma gallisepticum* CA06, *Myroides odoratus, Necropso-* bacter massiliensis, Neisseria arctica, Neisseria bacilliformis, Neisseria meningitidis, Neisseria sp., Neisseria sp. 74A18, Neisseria wadsworthii, Niabella soli, Nitratifractor salsuginis, Nitrosomonas sp. AL212, Novosphingobium sp. MD-1, Oceanivirga salmonicida, Oceanobacillus manasiensis, Odoribacter laneus, Oenococcus kitaharae DSM 17330, Oligella urethralis, Olsenella profusa, Olsenella sp. DNF00959, Olsenella uli, Ornithobacterium rhinotracheale, Ottowia sp. oral taxon 894, Pannonibacter phragmitetus, Parabacteroides johnsonii DSM 18315, Parabacteroides sp., Parabacteroides sp. D26, Parasutterella excrementihominis, Parvibaculum lavamentivorans, Parvimonas sp. KA00067, Pasteurella multocida, Pediococcus acidilactici, Pediococcus damnosus, Pediococcus inopinatus, Pediococcus parvulus, Pediococcus pentosaceus, Pediococcus stilesii, Pedobacter glucosidilyticus, Pelomonas sp. Root1237, Peptoniphilus duerdenii, Peptoniphilus obesi, Peptoniphilus sp. oral taxon 386, Peptostreptococcus anaerobius CAG: 621, Phascolarctobacterium succinatutens, Planococcus antarcticus, Porphyromonas catoniae, Porphyromonas gingivalis, Porphyromonas somerae, Porphyromonas sp. oral taxon 278, Prevotella amnii, Prevotella aurantiaca, Prevotella baroniae, Prevotella bivia, Prevotella buccalis, Prevotella corporis, Prevotella denticola, Prevotella disiens, Prevotella histicola, Prevotella intermedia, Prevotella loescheii, Prevotella melaninogenica, Prevotella nanceiensis, Prevotella nigrescens, Prevotella oralis, Prevotella pleuritidis, Prevotella ruminicola, Prevotella saccharolytica, Prevotella sp. C561, Prevotella sp. DNF00663, Prevotella sp. HJM029, Prevotella sp. HUN102, Prevotella sp. MSX73, Prevotella sp. oral taxon 306, Prevotella sp. oral taxon 317, Prevotella sp. P5-119, Prevotella stercorea, Propionimicrobium lymphophilum, Pseudaminobacter salicylatoxidans, Pseudomonas aeruginosa, Pseudomonas lini, Psychroflexus torquis, Psychroserpens sp. Hel_1_66, Ralstonia solanacearum, Rhodobacteraceae bacterium HLUCCA08, Rhodobacteraceae bacterium HLUCCA12, Rhodospirillum rubrum, Rhodovulum sp. PH10, Riemerella anatipestifer, Rikenella microfusus, Rikenellaceae sp., Rodentibacter pneumotropicus, Roseburia intestinalis, Roseburia sp. CAG: 197, Rothia aeria, Rothia dentocariosa, Rothia mucilaginosa, Rubritepida flocculans, Rugosibacter aromaticivorans, Ruminiclostridium cellulolyticum, Ruminococcus albus, Ruminococcus flavefaciens, Ruminococcus lactaris, Saccharibacter sp. AM169, Salegentibacter sp. Hel_1_6, Salinispira pacifica, Salinivirga cyanobacteriivorans, Salsuginibacillus kocurii, Scardovia inopinata, Scardovia wiggsiae, Schleiferia thermophila, Sedimenticola thiotaurini, Sediminibacterium sp. C3, Sharpea azabuensis, Shimia marina, Simonsiella muelleri, Skermanella aerolata, Solobacterium moorei, Sphaerochaeta globosa, Sphingobacterium spiritivorum, Sphingobium baderi, Sphingobium sp. AP49, Sphingobium sp. C100, Sphingomonas, Sphingomonas changbaiensis, Sphingomonas sanxanigenens, Sphingomonas sp. Leaf412, Sphingomonas sp. MM-1, Sphingomonas sp. SR52, Spiroplasma apis, Spiroplasma litorale, Spiroplasma turonicum, Sporocytophaga myxococcoides, Sporolactobacillus vineae, Staphylococcus agnetis, Staphylococcus haemolyticus, Staphylococcus hominis, Staphylococcus lugdunensis, Staphylococcus microti, Staphylococcus pasteuri, Staphylococcus pseudintermedius, Staphylococcus schleiferi, Staphylococcus simulans, Staphylococcus sp. CAG:324, Streptobacillus felis, Streptobacillus moniliformis, Streptococcus, Streptococcus agalactiae, Streptococcus anginosus, Streptococcus canis, Streptococcus constellatus, Streptococcus dysgalactiae, Streptococcus equi, Streptococcus equinus, Streptococcus gallolyticus, Streptococcus gordonii, Streptococcus henryi, Streptococcus infantarius, Streptococcus iniae, Streptococcus macacae, Streptococcus macedonicus, Streptococcus marimammalium, Streptococcus massiliensis, Streptococcus mitis, Streptococcus mutans, Streptococcus oralis, Streptococcus oralis subsp. tigurinus AZ 3a, Streptococcus orisasini, Streptococcus orisratti, Streptococcus ovis, Streptococcus parasanguinis, Streptococcus plurextorum, Streptococcus pseudopneumoniae, Streptococcus pseudoporcinus, Streptococcus pyogenes, Streptococcus ratti, Streptococcus sanguinis, Streptococcus sinensis, Streptococcus sobrinus, Streptococcus sp. C150, Streptococcus sp. C300, Streptococcus sp. HSISB1, Streptococcus sp. I-G2, Streptococcus suis, Streptococcus thermophilus, Streptococcus varani, Streptococcus_agalactiae_NEM316, Streptococcus_dysgalactiae_subsp._equisimilis AC-2713, Streptococcus_gallolyticus_subsp._gallolyticus_ATCC_43143, Streptococcus_gordonii_str._Challis_substr._CH1, Streptococcus_mutans_GS-5, Streptococcus_salivarius_JIM8777, Streptococcus_suis_D9, Streptococcus_thermophilus_LMG_18311, Subdoligranulum_sp._4_3_54A2FAA, Sulfitobacter donghicola, Sulfuritalea hydrogenivorans, Sulfurospirillum sp., Sulfurospirillum sp. SCADC, Sulfurovum lithotrophicum, Sutterella wadsworthensis, Tamlana sedimentorum, Tannerella forsythia, Tenacibaculum maritimum, Thermithiobacillus tepidarius, Thermophagus xiamenensis, Thioalkalivibrio, Tissierellia bacterium K400581, Tissierellia bacterium S5-A11, Tistrella mobilis, Treponema denticola, Treponema maltophilum, Treponema pedis, Treponema putidum, Treponema socranskii, Treponema_denticola_ATCC_35405, Turicibacter sp., uncultured Termite group 1 bacterium, Ureibacillus thermosphaericus, Urinacoccus massiliensis, Veillonella atypica, Veillonella magna, Veillonella parvula, Veillonella parvula ATCC 17745, Veillonella sp. 6_1_27, Veillonella sp. AS16, Veillonella sp. CAG:933, Veillonella sp. DNF00869, Veillonella sp. DorA_A_3_16_22, Verminephrobacter aporrectodeae, Verminephrobacter eiseniae, Verrucomicrobia bacterium IMCC2613, Virgibacillus senegalensis, Weeksella massiliensis, Weeksella virosa, Weissella halotolerans, Weissella kandleri, Wolinella succinogenes, Woodsholea maritima, Yoonia vestfoldensis, and Zunongwangia profunda.

In some aspects, the invention provides a synthetic composition comprising a heterologous component and a polypeptide selected from the group consisting of: a polypeptide sharing at least 80%, between 80% and 85%, at least 85%, between 85% and 90%, at least 90%, between 90% and 95%, at least 95%, at least 96%, at least 97%, at least 98%, at least 99%, at least 99.5%, or greater than 99.5% identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, between 500 and 550, at least 550, between 550 and 600, at least 600, between 600 and 650, at least 650, between 650 and 700, at least 700, between 700 and 750, at least 750, between 750 and 800, at least 800, between 800 and 850, at least 850, between 850 and 900, at least 900, between 900 and 950, at least 950, between 950 and 1000, at least 1000, or even than 1000 contiguous amino acids of any of any of: SEQ ID NO:86-171 and 511-1135; a functional variant of any of SEQ ID NO:86-171 and 511-1135; a functional fragment of any of SEQ ID NO:86-171 and 511-1135; a Cas endonuclease encoded by a polynucleotide selected from the group consisting of: SEQ ID NO:1-85; a Cas endonuclease that recognizes a PAM sequence listed in any of Tables 4-83; a Cas endonuclease that recognizes a PAM sequence selected from the group consisting of: NAR (G>A)WH (A>T>C)GN (C>T>R), N (C>D)V (A>S)R (G>A)TTTN (T>V), NV (A>G>C)TTTTT, NATTTTT, NN (H>G)AAAN (G>A>Y)N, N (T>V)NAAATN, NAV (A>G>C)TCNN, NN (A>S>T)NN (W>G>C)CCN (Y>R), NNAH (T>M)ACN, NGTGANN, NARN (A>K>C)ATN, NV (G>A>C)RNTTN, NN (A>B)RN (A>G>T>C)CCN, NN (A>B)NN (T>V)CCH (A>Y), NNN (H>G)NCDAA, NN (H>G)D (A>K)GGDN (A>B), NNNNCCAG, NNNNCTAA, NNNNCVGANN (SEQ ID NO:1746), N (C>D)NNTCCN, NNNNCTA, NNNNCYAA, NAGRGNY, NNGH (W>C)AAA, NNGAAAN, NNAAAAA, NTGAR (G>A)N(A>Y>G)N (Y>R), N (C>D)H (C>W)GH (Y>A)N(A>B)AN(A>T>S), NNAAACN, NNGTAM (A>C)Y, NH (A>Y)ARNN (C>W>G)N, B (C>K)GGN(A>Y>G)N NN, N (T>C>R) AGAN (A>K>C)NN, NGGN (A>T>G>C)NNN, NGGD (A>T>G)TNN, NGGAN(T>A>C>G)NN, CGGWN (T>R>C)NN, NGGWGNN, N (B>A)GGNN (T>V)NN, NNGD (A>T>G)AY (T>C)N, N (T>V)H(T>C>A)AAAAN, NRTAANN, N (H>G)CAAH (Y>A)N(Y>R)N, NATAAN (A>T>S)N, NV (A>G>C)R (A>G)ACCN, CN (C>W>G) AV (A>S)GAC, NNRNCAC, N(A>B)GGD (W>G)D (G>W)NN, BGD (G>W)GTCN(A>K>C), NAANACN, NRTHAN(A>B)N, BHN (H>G)NGN(T>M)H(Y>A), NMRN(A>Y>G)AH(C>T>A)N, NNNCACN, NARN (T>A>S)ACN, NNNNATW, NGCNGCN, NNNCATN, NAGNGCN, NARN(T>M>G)CCN, NATCCTN, NRTAAN (T>A>S)N, N(C>T>G>A)AAD (A>G>T)CNN, NAAAGNN, NNGACNN, N(T>V)NTAAD (A>T>G)N, NNGAD (G>W)NN, NGGN(W>S)NNN, N(T>V)GGD (W>G)GNN, NGGD(A>T>G)N(T>M>G)NN, NNAAAGN, N(G>H)GGDN(T>M>G)NN, NNAGAAA, NN(T>M>G)AAAAA, N(C>D)N(C>W>G)GW(T>C)D (A>G>T)AA, NAAAAYN, NRGNNNN, NATGN (H>G) TN, NNDATTT, and NATARCN(C>T>A>G); a Cas endonuclease that is capable of recognizing a PAM sequence that is one, two, three, four, five, six, seven, eight, nine, or ten nucleotides in length; a Cas endonuclease that comprises a domain at least 80%, between 80% and 85%, at least 85%, between 85% and 90%, at least 90%, between 90% and 95%, at least 95%, at least 96%, at least 97%, at least 98%, at least 99%, at least 99.5%, or greater than 99.5% identity with any of: SEQ ID NOs: 1136-1730; a Cas endonuclease that has an activity score, according to the identical or similar method of Example 9 or summations of position scores of the amino acid table of Table 86A, of at least 1.0, between 1.0 and 2.0, at least 2.0, between 2.0 and 3.0, at least 3.0, between 3.0 and 4.0, at least 4.0, between 4.0 and 5.0, at least 5.0, between 5.0 and 6.0, at least 6.0, between 6.0 and 7.0, at least 7.0, between 7.0 and 8.0, at least 8.0, between 8.0 and 9.0, at least 9.0, between 9.0 and 10.0, at least 10.0, or even greater than 10.0; a Cas endonuclease comprising one, two, three, four, five, six, seven, eight, nine, ten, eleven, twelve, thirteen, fourteen, fifteen, sixteen, seventeen, eighteen, nineteen, twenty, twenty-one, twenty-two, twenty-three, twenty-four, twenty-five, or twenty-six of the signature amino acids identified in Table 86B, as compared to an alignment with the relative sequence position numbers of SEQ ID NO:1125; and a Cas endonuclease that is capable of forming a complex with a guide polynucleotide comprising any one of SEQ ID NOs: 426-510, 341-425, 141-255, or 256-340. In some aspects, the Cas9 polynucleotide has a plurality of the previously listed features.

In some aspects, the invention provides guide polynucleotide(s) and/or component(s) that is(are) capable of forming a complex with a Cas endonuclease to recognize, bind to, and optionally nick or cleave a target polynucleotide. In some aspects, the guide polynucleotide comprises a sequence at least 80%, between 80% and 85%, at least 85%, between 85% and 90%, at least 90%, between 90% and 95%, at least 95%, at least 96%, at least 97%, at least 98%, at least 99%, at least 99.5%, or greater than 99.5% identity with any of SEQ ID NOs: 426-510, 341-425, 171-255, or 256-340.

In some aspects, the invention provides a Cas endonuclease that is capable of creating a single strand break, or a nick in a double-stranded target polynucleotide. In some aspects, the Cas endonuclease is capable of creating a sticky-end overhang double strand break. In some aspects, the Cas endonuclease is capable of creating a blunt-end double strand break.

In some aspects, said heterologous component is selected from the group consisting of: a cell, a heterologous polynucleotide, a donor DNA molecule, a repair template polynucleotide, a heterologous polypeptide, a deaminase, a heterologous nuclease, a particle, a solid matrix, an antibody, a buffer composition, Tris, EDTA, dithiothreitol (DTT), phosphate-buffered saline (PBS), sodium chloride, magnesium chloride, HEPES, glycerol, bovine serum albumin (BSA), a salt, an emulsifier, a detergent, a chelating agent, a redox reagent, an antibody, nuclease-free water, a viscosity agent, and a Histidine tag. In some aspects, said heterologous polypeptide comprises a nuclease domain, a transcriptional activator domain, a transcriptional repressor domain, an epigenetic modification domain, a cleavage domain, a nuclear localization signal, a cell-penetrating domain, a deaminase domain, a base editing domain, a translocation domain, a marker, and a transgene. In some aspects, said heterologous polynucleotide is selected from the group consisting of: a guide polynucleotide, a chimeric guide polynucleotide, a chemically modified guide polynucleotide, a guide polynucleotide comprising both DNA and RNA, a noncoding expression element, a gene, a marker, and a polynucleotide encoding a plurality of Histidine residues. In some aspects, the synthetic composition comprises at least two, at least three, at least four, at least five, or even greater than five heterologous components. In some aspects, there is a plurality of different heterologous components. In some aspects, there is a plurality of heterologous components of the same type. In some aspects, there is a plurality of identical heterologous components.

In some aspects, the pH of the synthetic composition is between 1.0 and 14.0, between 2.0 and 13.0, between 3.0 and 12.0, between 4.0 and 11.0, between 5.0 and 10.0, between 6.0 and 9.0, between 7.0 and 8.0, between 4.5 and 6.5, between 5.5 and 7.5, or between 6.5 and 7.5. In some aspects, the Cas9 ortholog has an activity optimum at a pH between 1.0 and 14.0, between 2.0 and 13.0, between 3.0 and 12.0, between 4.0 and 11.0, between 5.0 and 10.0, between 6.0 and 9.0, between 7.0 and 8.0, between 4.5 and 6.5, between 5.5 and 7.5, or between 6.5 and 7.5.

In some aspects, said Cas9 ortholog has an activity optimum at a temperature between 0 degrees Celsius and 100 degrees Celsius, between at least 0 degrees Celsius and 10 degrees Celsius, between at least 10 degrees Celsius and 20 degrees Celsius, between at least 20 degrees Celsius and 25 degrees Celsius, between at least 25 degrees Celsius and 30 degrees Celsius, between at least 30 degrees Celsius and 40 degrees Celsius, between at least 40 degrees Celsius and 50 degrees Celsius, between at least 50 degrees Celsius and 60 degrees Celsius, between at least 60 degrees Celsius and 70 degrees Celsius, between at least 70 degrees Celsius and 80 degrees Celsius, between at least 80 degrees Celsius and 90 degrees Celsius, between at least 90 degrees Celsius and 100 degrees Celsius, or greater than 100 degrees Celsius.

In some aspects, the synthetic composition is stored or incubated at a temperature of at least minus 200 degrees Celsius, at least minus 150 degrees Celsius, at least minus 135 degrees Celsius, at least minus 90 degrees Celsius, at least minus 80 degrees Celsius, at least minus 20 degrees Celsius, at least 4 degrees Celsius, at least 17 degrees Celsius, at least 25 degrees Celsius, at least 30 degrees Celsius, at least 35 degrees Celsius, at least 37 degrees Celsius, at least 39 degrees Celsius, or greater than 39 degrees Celsius.

In some aspects, any of the synthetic compositions may be in a substantially nuclease-free environment. In some aspects, any of the synthetic compositions may be in a substantially endotoxin-free environment. In some aspects, any of the synthetic compositions may be in a substantially nuclease-free and endotoxin-free environment. In some aspects, any of the synthetic compositions may be lyophilized. In some aspects, any of the synthetic compositions may exist in an aqueous solution. In some aspects, any of the synthetic compositions may exist in a non-aqueous solution.

In one aspect, the invention provides a method of modulating target polynucleotide specificity of a Cas9 ortholog/guide polynucleotide complex as compared to its wild type activity, by changing a parameter selected from the group consisting of: guide polynucleotide length, guide polynucleotide composition, length of PAM recognition sequence, composition of the PAM recognition sequence, and affinity of the Cas9 molecule with the target polynucleotide backbone; and assessing the target polynucleotide specificity of the complex with the changed parameter, and comparing it to the activity of a complex with wild type parameters. In some embodiments, target polynucleotide specificity may be increased with a longer PAM recognition sequence. In some embodiments, target polynucleotide specificity may be decreased with a shorter PAM recognition sequence. In some embodiments, target polynucleotide specificity may be modulated by engineering a non-naturally occurring PAM recognition sequence.

In one aspect, the invention provides a method of optimizing the activity of a Cas9 molecule by subjecting a parental Cas9 molecule to at least one round of stochastic protein shuffling or molecular evolution, and selecting a resultant molecule that has at least one characteristic not present in the parental Cas9 molecule. In some embodiments, multiple rounds may be performed.

In one aspect, the invention provides a method of optimizing the activity of a Cas9 molecule by subjecting a parental Cas9 molecule to at least one round of non-stochastic protein shuffling or molecular evolution, and selecting a resultant molecule that has at least one characteristic not present in the parental Cas9 molecule. In some embodiments, multiple rounds may be performed.

In one aspect, the invention provides, using any of the compositions provided herein or any composition derived from the compositions provided herein or any composition identified using any of the methods provided herein, methods of effecting a single-strand nick or a double-strand break of a target polynucleotide, methods of modifying an isolated or genomic polynucleotide, methods of in vitro polynucleotide modification, methods of in vivo polynucleotide modification, methods of editing one or more bases of a polynucleotide, methods of modulating the expression of an endogenous or transgenic polynucleotide in a cell, or methods of conferring a benefit to a cell, tissue, or organism to which the composition has been introduced.

Methods of genomic modification provided herein include the insertion of at least one nucleotide, the deletion of at least one nucleotide, the modification of at least one nucleotide, the swap of at least one nucleotide, the chemical alteration of at least one nucleotide, the deamination of at least one nucleotide, or any combination of the preceding.

In some aspects, the Cas endonuclease has been modified to alter its wild type activity, to cleave a target polynucleotide with greater frequency, to cleave a polynucleotide with less frequency, or to reduce or eliminate nuclease activity.

In some aspects, the Cas endonuclease is combined with another polypeptide to create a fusion protein, for example with a deaminase or a heterologous nuclease.

In any aspect of the methods or compositions provided herein, the cell may be selected from the group consisting of: a human, non-human primate, mammal, animal, archaeal, bacterial, protist, fungal, insect, yeast, non-conventional yeast, and plant cell. In some embodiments, the cell is heterologous to the organism from which the Cas9 endonuclease was derived. In some embodiments, the cell is a plant cell selected from the group consisting of a monocot and dicot cell. In some embodiments, the cell is a plant cell selected from the group consisting of maize, rice, sorghum, rye, barley, wheat, millet, oats, sugarcane, turfgrass, switchgrass, soybean, canola, alfalfa, sunflower, cotton, tobacco, peanut, potato, tobacco, *Arabidopsis*, vegetable, and safflower cell. In some embodiments, the cell is an animal cell, optionally a mammalian cell, optionally a primate cell, or optionally a human cell, that is selected from the group consisting of: haploid cells, diploid cells, reproductive cells, neurons, muscle cells, endocrine or exocrine cells, epithelial cells, muscle cells, tumor cells, embryonic cells, hematopoietic cells, bone cells, germ cells, somatic cells, stem cells, pluripotent stem cells, induced pluripotent stem cells, progenitor cells, meiotic cells, and mitotic cells.

In any aspect, a benefit is conferred to said cell, or organism comprising said cell, or subsequent generation of cells or organisms derived from said cell, as a result of a composition or method provided herein. In some embodiments, the benefit is ascertained by comparing said cell, organism comprising said cell, or subsequent generation of cells or organisms derived from said cell, to an isoline cell not subjected to a method provided herein, or not comprising at least one composition provided herein. In some embodiments, the benefit is provided as a result of a polynucleotide modification, deletion, or, insertion. In some embodiments, said benefit is selected from the group consisting of: improved health, improved growth, improved fertility, improved fecundity, improved environmental tolerance, improved vigor, improved disease resistance, improved disease tolerance, improved tolerance to a heterologous molecule, improved fitness, improved physical characteristic, greater mass, increased production of a biochemical molecule, decreased production of a biochemical molecule, upregulation of a gene, downregulation of a gene, upregulation of a biochemical pathway, downregulation of a biochemical pathway, stimulation of cell reproduction, and suppression of cell reproduction, as compared to an isoline plant not comprising or derived from a cell comprising said donor polynucleotide. In some embodiments, the modification of said target site results in the modulation of a trait of agronomic interest of a plant comprising, or derived from, said cell or a progeny cell thereof, said trait of agronomic interest selected from the group consisting of: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, improved fertility, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition; as compared to an isoline plant not comprising or derived from a cell comprising said donor polynucleotide. In some embodiments, the cell is an animal cell, wherein the modification of said target site results in the modulation of a phenotype of physiological interest of an organism comprising said animal cell or a progeny cell thereof, selected from the group consisting of: improved health, improved nutritional status, reduced disease impact, disease stasis, disease reversal, improved fertility, improved vigor, improved mental capacity, improved organism growth, improved weight gain, weight loss, modulation of an endocrine system, modulation of an exocrine system, reduced tumor size, reduced tumor mass, stimulated cell growth, reduced cell growth, production of a metabolite, production of a hormone, production of an immune cell, and stimulation of cell production.

BRIEF DESCRIPTION OF THE DRAWINGS AND THE SEQUENCE LISTING

The disclosure can be more fully understood from the following detailed description and the accompanying drawings and Sequence Listing, which form a part of this application. The sequence descriptions and sequence listing attached hereto comply with the rules governing nucleotide and amino acid sequence disclosures in patent applications as set forth in 37 C.F.R. §§ 1.821 and 1.825. The sequence descriptions comprise the three letter codes for amino acids as defined in 37 C.F.R. §§ 1.821 and 1.825, which are incorporated herein by reference.

FIGURES

FIG. 3 shows the consensus PAM sequences determined for some of the Cas9 orthologs of each of the 12 clades described in Example 1, as detailed in Tables 4-83.

FIG. 4 shows the consensus sequence for Group I Cas9 orthologs (SEQ ID NOs: 58, 62, 64, 63, 65, 71, 69, 74, 66, 67, 70, 72, 73, 68, 83, 79, 82, 76, 78, 80, 81, 77, and 75), which were aligned against the *Staphylococcus aureus* Cas9 structure PDB ID 5CZZ_A ("Crystal structure of *Staphylococcus aureus* Cas9", Nishimasu, H., Cong, L., Yan, W. X., Ran, F. A., Zetsche, B., Li, Y., Kurabayashi, A., Ishitani, R., Zhang, F., Nureki, O., (2015) *Cell* 162: 1113-1126). Absolutely conserved residues are depicted in bold, underlined text (X).

FIG. 5 shows the consensus sequence for Group III Cas9 orthologs (SEQ ID NOs: 51, 52, 53, 54, 55, 56, 57, 59, 84, 85, 86, 87, 88, 89, 90, 91, 92, 93, 94, 95, 96, and 97), which aligned against the *Streptococcus pyogenes* serotype M1 structure PDB ID 4UN3_B ("Structural Basis of Pam-Dependent Target DNA Recognition by the Cas9 Endonuclease", Anders, C., Niewoehner, O., Duerst, A., Jinek, M., (2014) *Nature* 513: 569-573). Absolutely conserved residues are depicted in bold, underlined text (X).

FIG. 6 shows the consensus sequence for Group IV Cas9 orthologs (SEQ ID NOs: 98 and 99), which were aligned against the *Actinomyces naeslundii* structure PDB ID 4OGE_A ("Structures of Cas9 endonucleases reveal RNA-mediated conformational activation", Jinek, M., Jiang, F., Taylor, D. W., Sternberg, S. H., Kaya, E., Ma, E., Anders, C., Hauer, M., Zhou, K., Lin, S., Kaplan, M., Iavarone, A. T., Charpentier, E., Nogales, E., Doudna, J. A., (2014) *Science* 343: 1247997-1247997). Absolutely conserved residues are depicted in bold, underlined text (X).

Figure 7A:
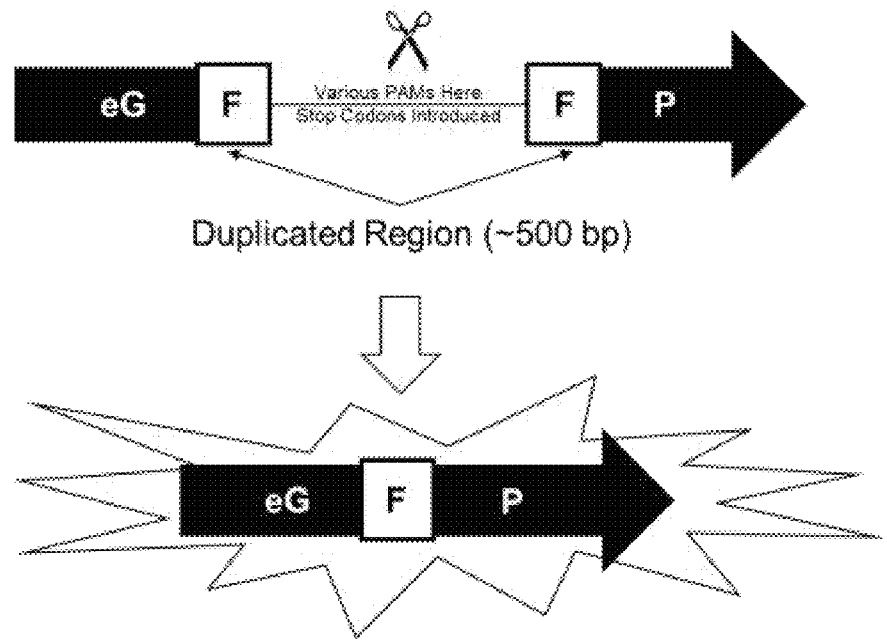
Figure 7B:
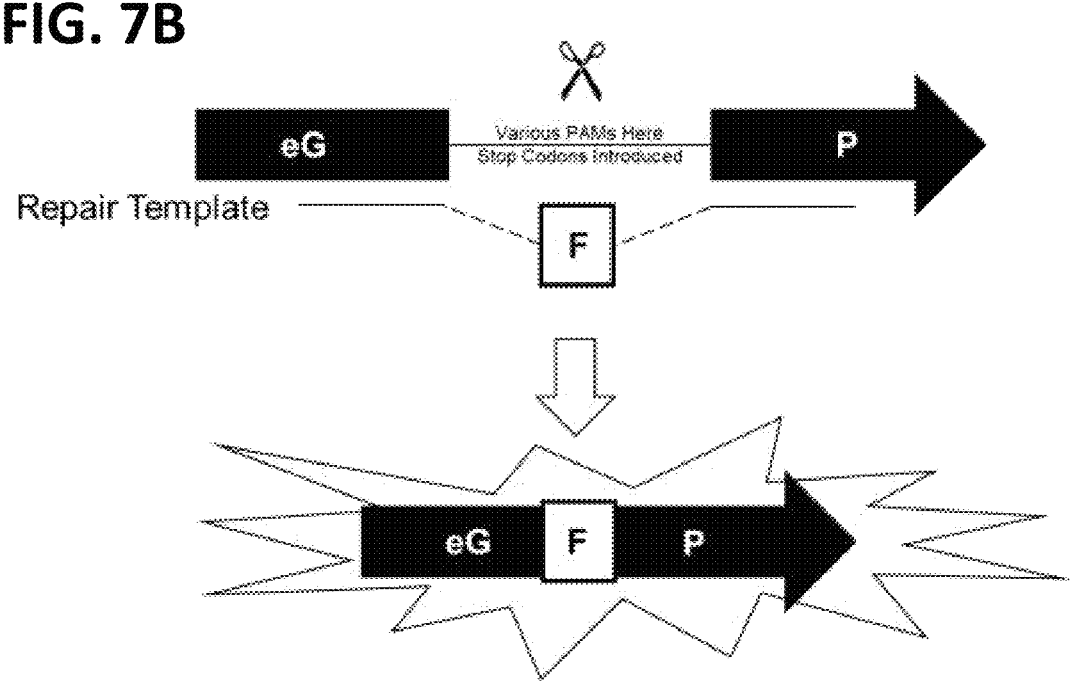

FIGS. 7A and 7B show the experimental approaches described in Example 9 for testing the HDR frequency after cleavage with Cas9: FIG. 7A depicts HDR via duplicated region of fluorescent reporter, and FIG. 7B depicts the repair template introduced together with Cas9.

Figure 8:
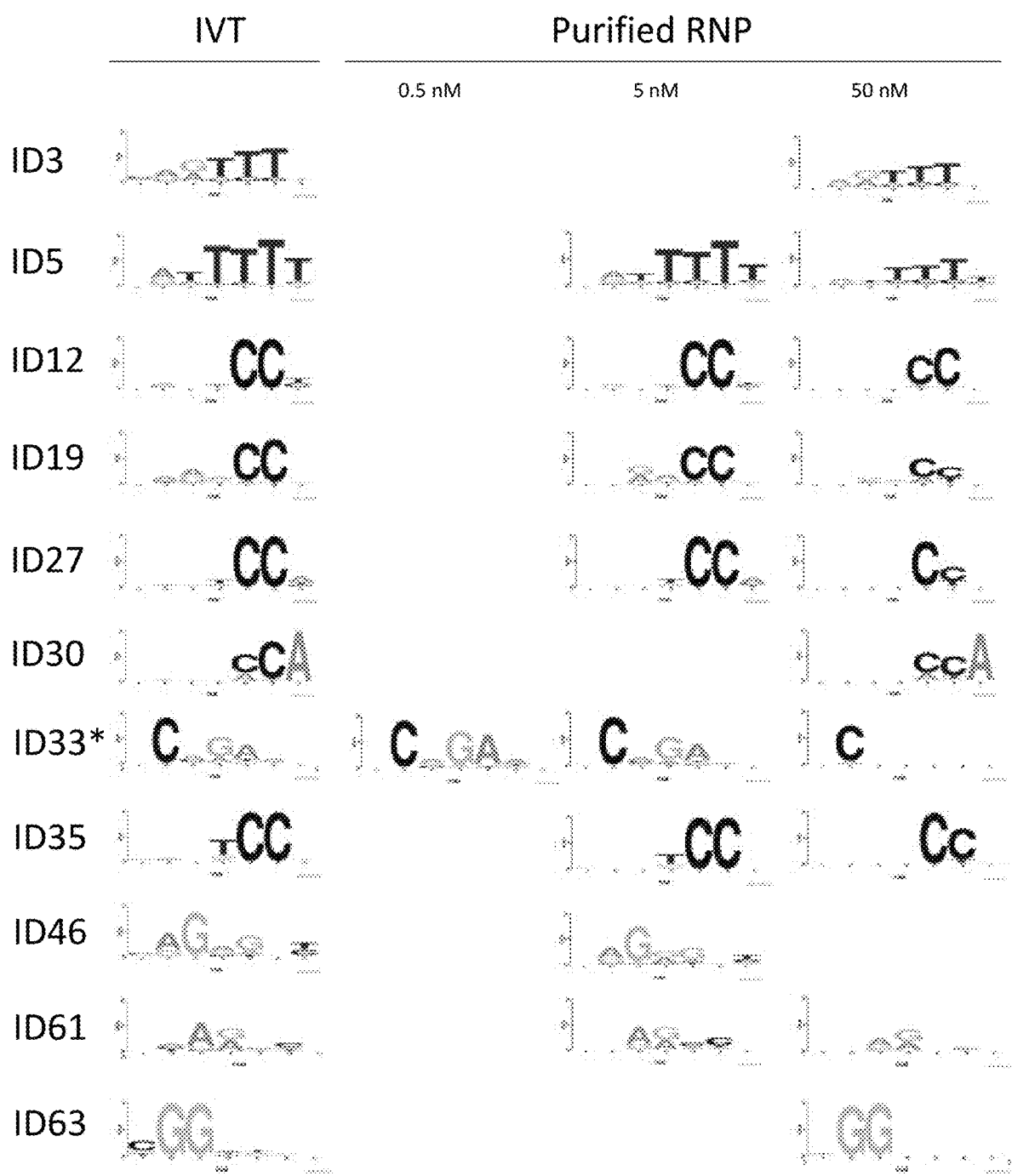

FIG. 8 shows WebLogo comparisons for selected Cas9 orthologs across two different methods (IVT and RNP). IVT method results were confirmed with purified ribonucleoprotein (RNP), at several different concentrations.

FIGS. 9A, 9B, and 9C show Protospacer-adapter ligation positions where Illumina sequences were recovered in excess resulting in a peak or spike of read coverage over negative controls were denoted as the cleavage position, with numerical results as fraction of adapter ligated reads. FIG. 9A shows the results for selected sequences of Clades I, II, III, and V. FIG. 9B shows the results for selected sequences of Clades VI, VII, VIII, and IX. FIG. 9C shows the results for selected sequences of Clades X, XI, and XII.

Figure 10A:
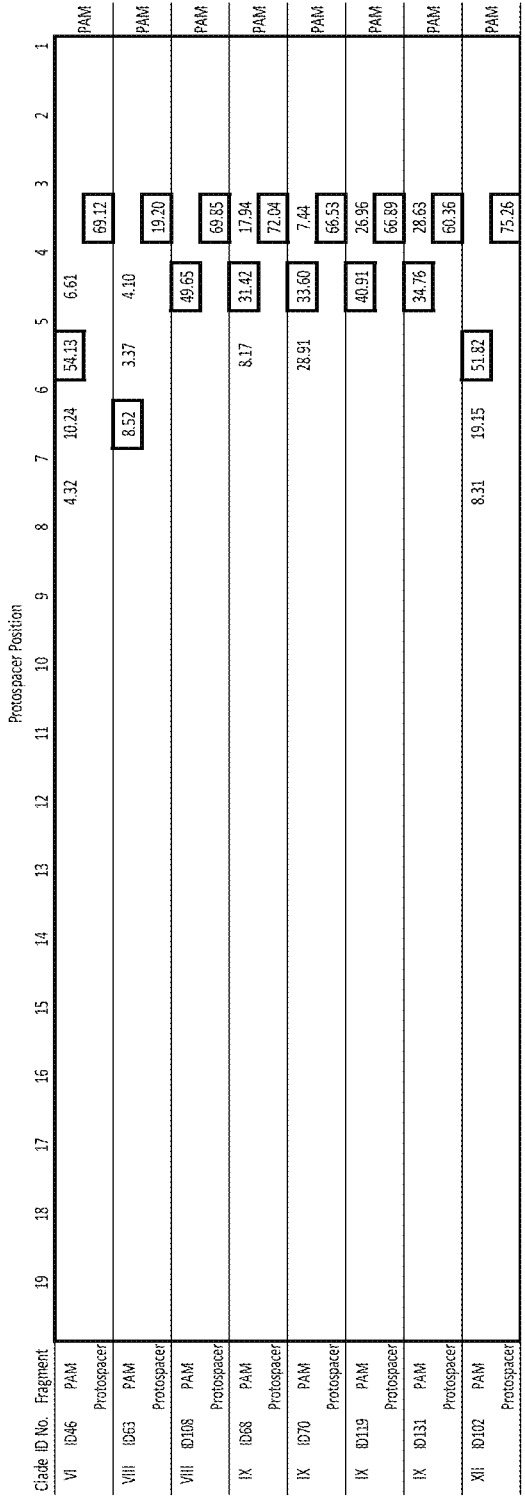

FIG. 10A shows those Cas9 proteins that produced dominant cleavage at a protospacer position other than just after 3 were then re-examined by also capturing the cleavage product resulting from cleavage, end-repair, 3' adenine addition, and adapter ligation of protospacer side of the cleaved library target.

Figure 10B:

FIG. 10B shows the position and type of cleavage, based on the resulting frequencies compared for both the protospacer and PAM sides of cleavage, taking T4 DNA polymerase end-repair into consideration, for eight of the selected Cas9 orthologs that demonstrated sticky-end cleavage.

Figure 11:
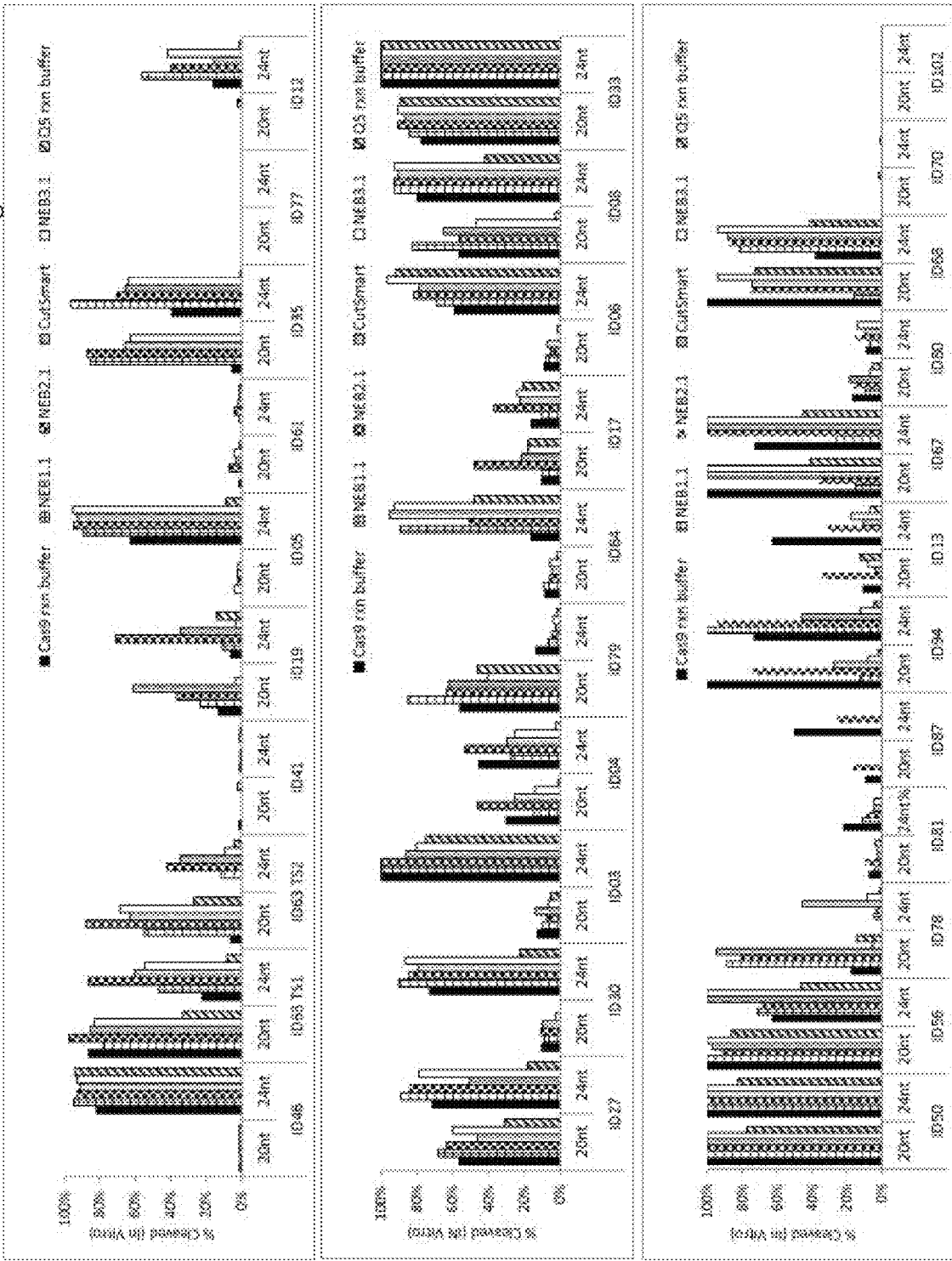

FIG. 11 shows in vitro cleavage data for some of the Cas9 orthologs tested with two different lengths of spacers (20 nucleotides and 24 nucleotides) in five different buffer compositions.

Figure 12A:
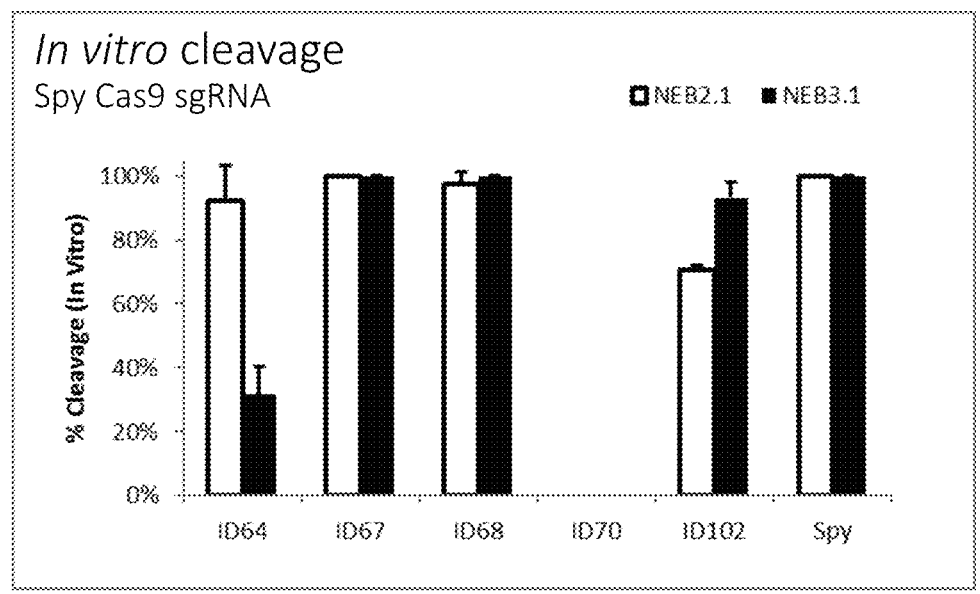
Figure 12B:
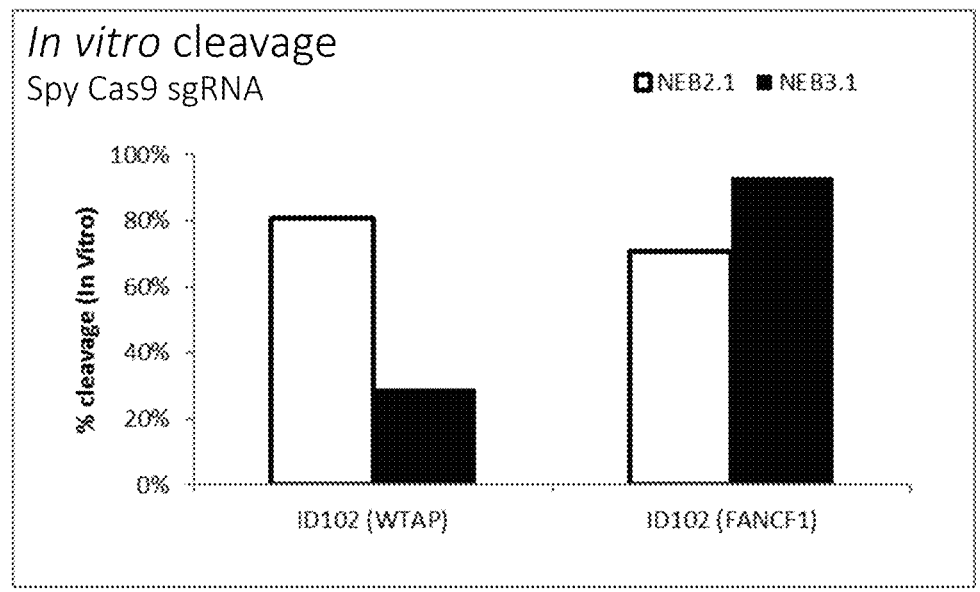

FIGS. 12A and 12B show in vitro cleavage data for selected Cas9 orthologs using the *S. pyogenes* sgRNA. FIG. 12A depicts in vitro cleavage data for ID64, ID67, ID68, ID70, ID102, and the control *S. pyogenes* Cas9. FIG. 12B depicts in vitro cleavage data for ID102 at the WTAP and FANCF1 loci.

Figure 13:
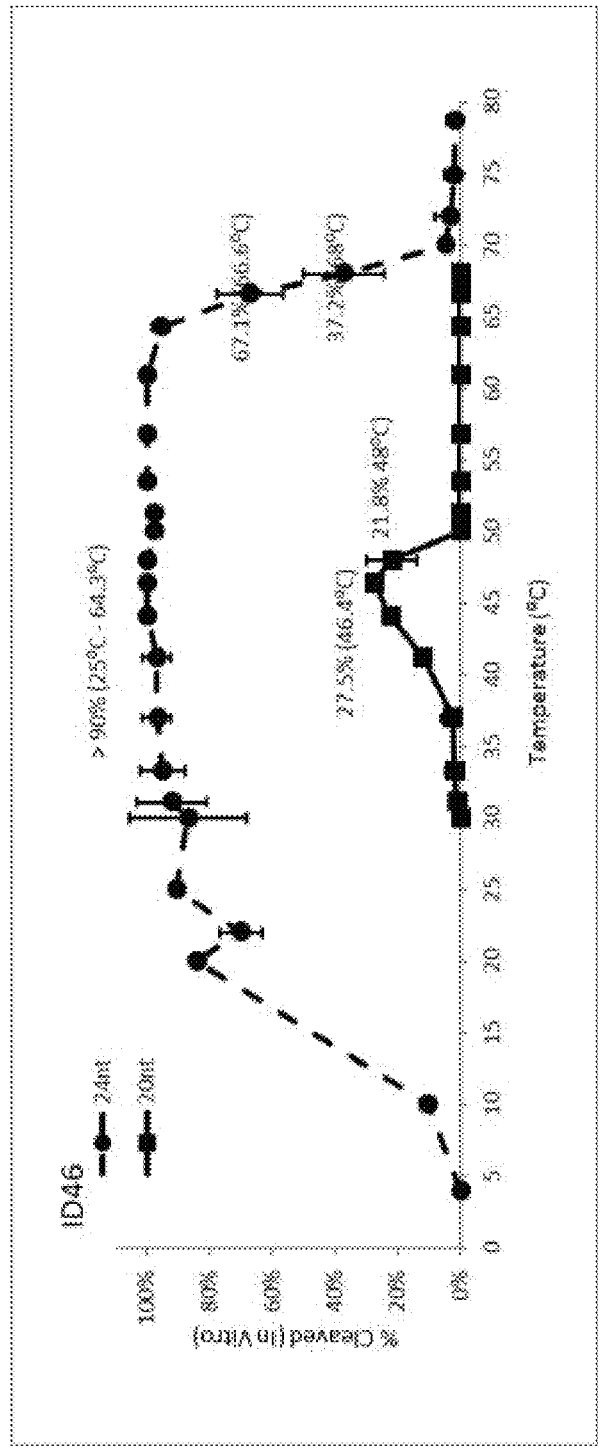

FIG. 13 shows in vitro cleavage activity versus temperature for one of the Cas9 orthologs, ID46, showing a wide range of temperature activity, with optimal activity from about 15 degrees Celsius to about 60 degrees Celsius with a 24 nucleotide spacer length, and a narrow window of activity with a maximum at approximately 45 degrees Celsius with a 20 nucleotide spacer length.

Figure 14:
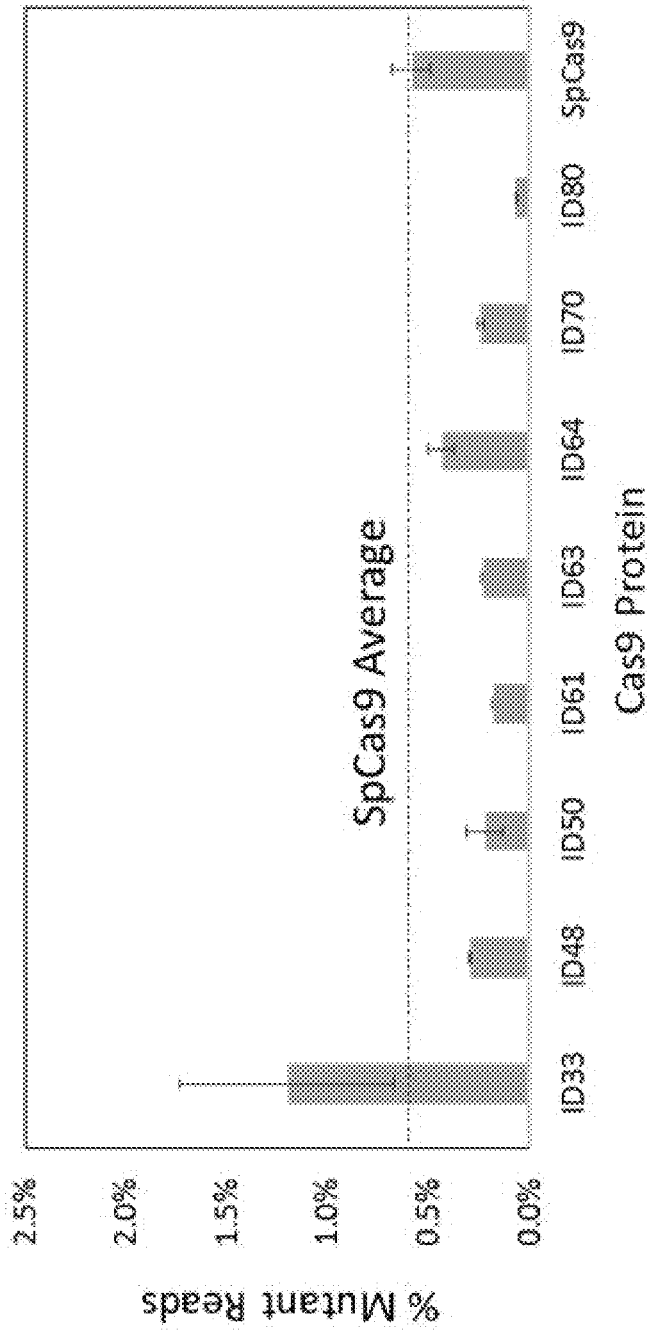

FIG. 14 shows the average NHEJ frequency in maize cells two days after transformation, with a representative number of Cas9 orthologs.

FIGS. 15A and 15B show the expected cut sites in 20 different mutants generated by selected Cas9 orthologs. FIG. 15A shows the results for ID33, and FIG. 15B shows the results for ID64.

Figure 16A:
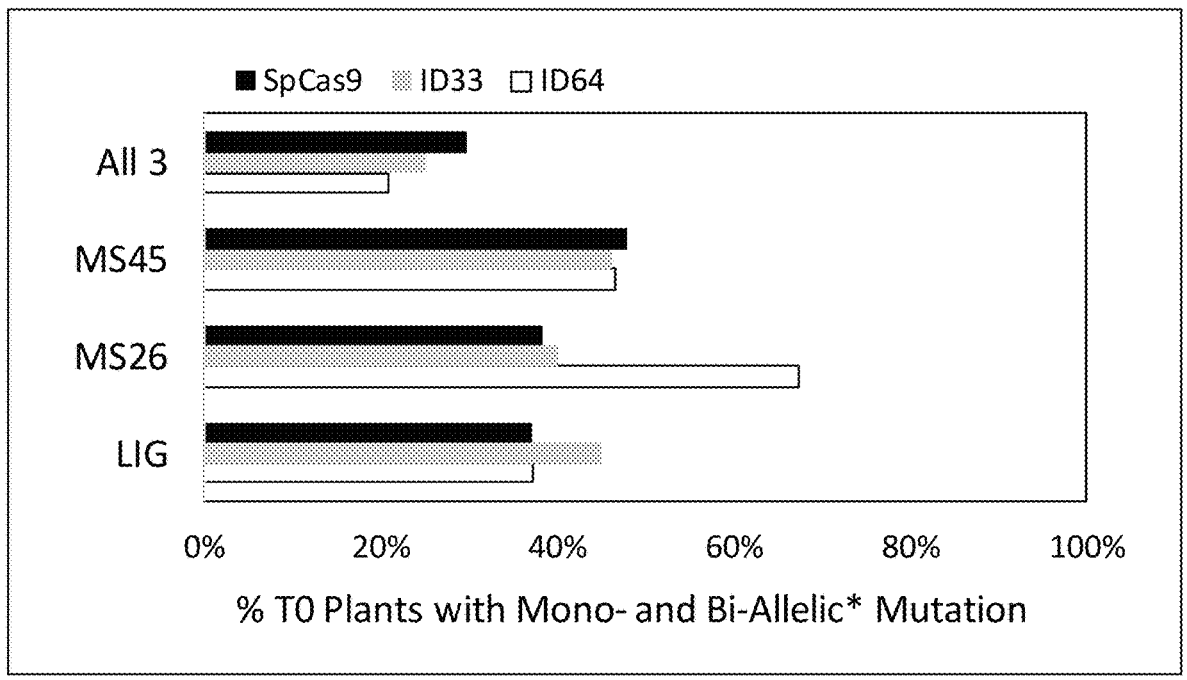
Figure 16B:
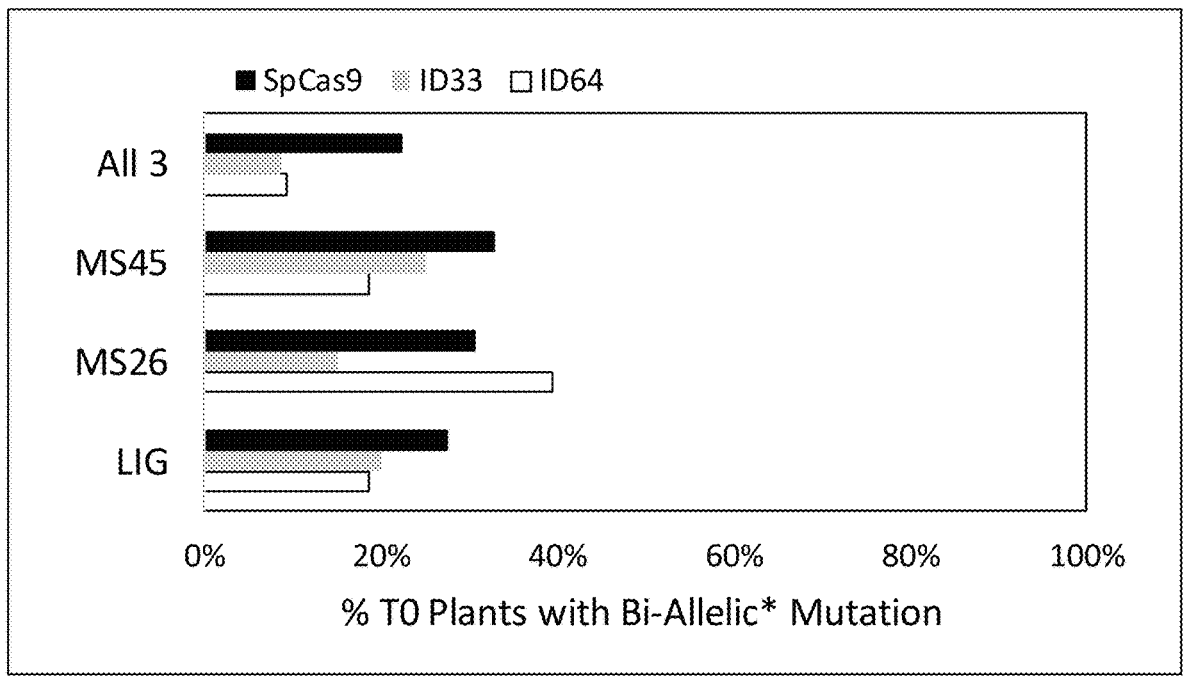

FIGS. 16A and 16B show shows the % T0 plants with mono- and bi-allelic mutations (FIG. 16A) and bi-allelic mutations (FIG. 16B) results of two different Cas9 orthologs (ID33 and ID64) across three different target sites (MS45, MS26, and LIG) in maize T0 plants, as compared to control plants modified with *S. pyogenes* Cas9.

Figure 17:
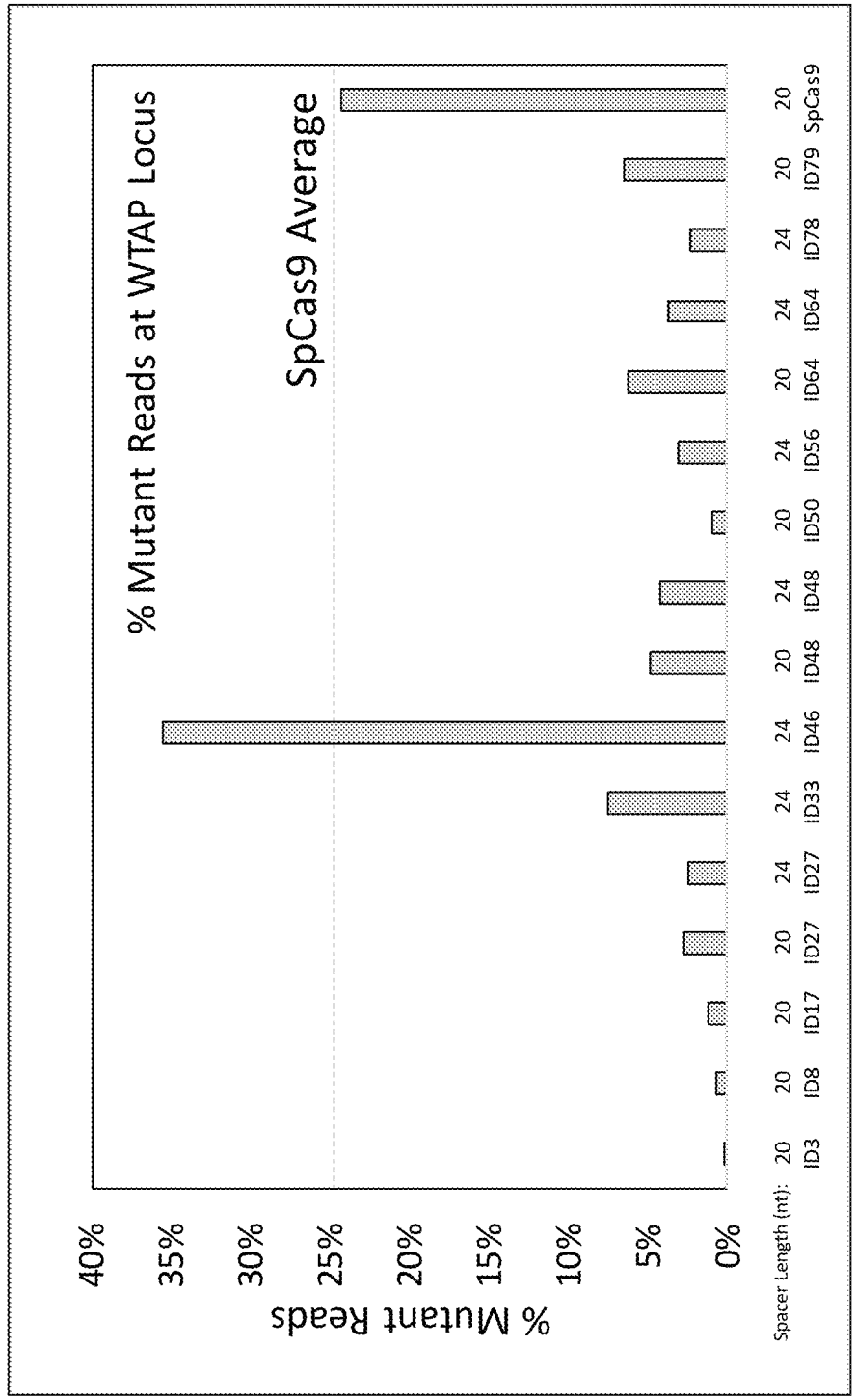

FIG. 17 shows the results of selected Cas9 orthologs at the HEK cell WTAP locus, as compared to the activity of *S. pyogenes* Cas9, in cells transformed with a recombinant construct comprising a DNA sequence encoding the respective Cas9 ortholog.

Figure 18:
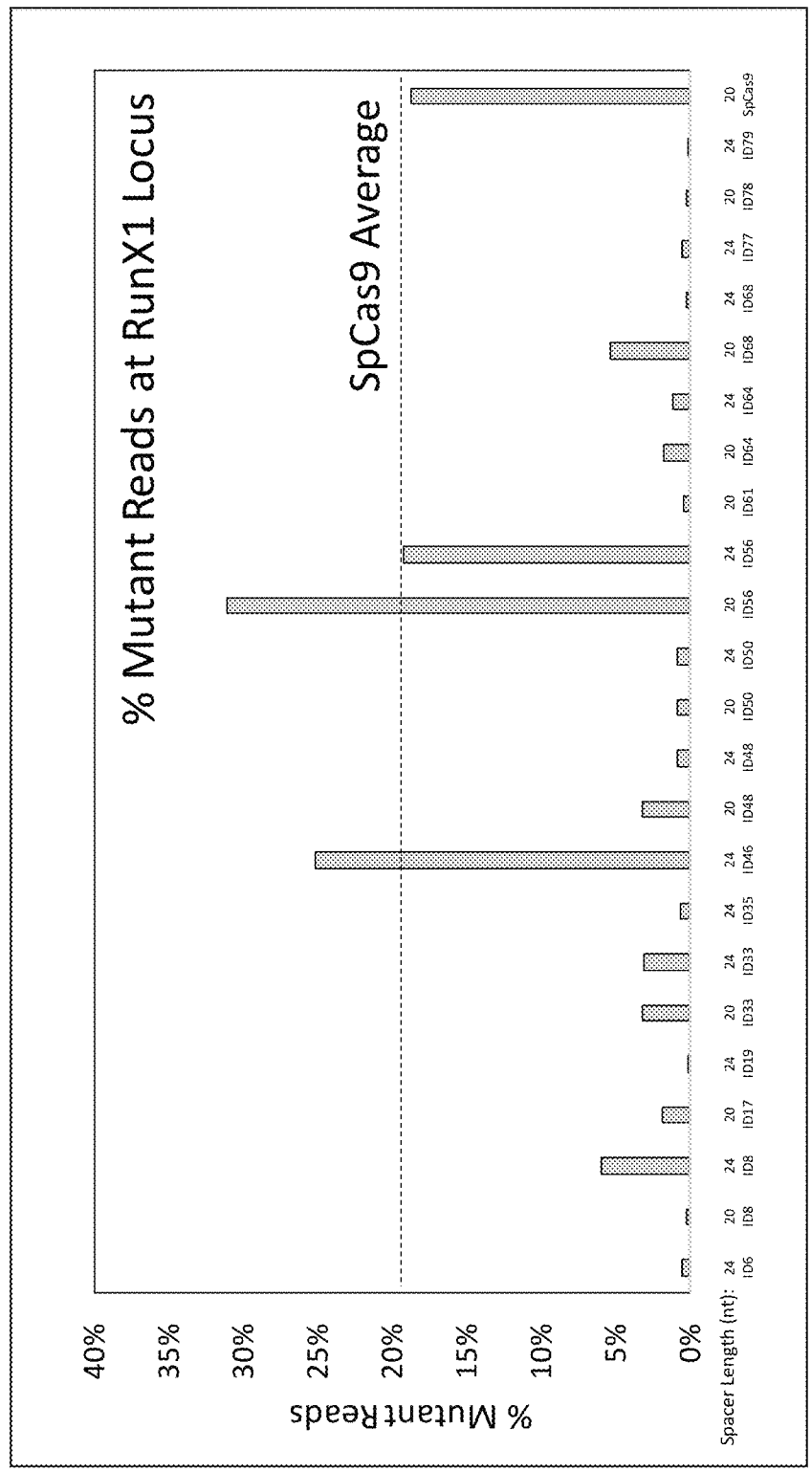

FIG. 18 shows the results of selected Cas9 orthologs at the HEK cell RunX1 locus, as compared to the activity of *S. pyogenes* Cas9, in cells transformed with a recombinant construct comprising a DNA sequence encoding the respective Cas9 ortholog.

FIGS. 19A and 19B show the expected cut sites in 20 different mutants generated by selected Cas9 orthologs. FIG. 19A shows the results for ID46 and FIG. 19B shows the results for ID56, in maize cells.

Figure 20:
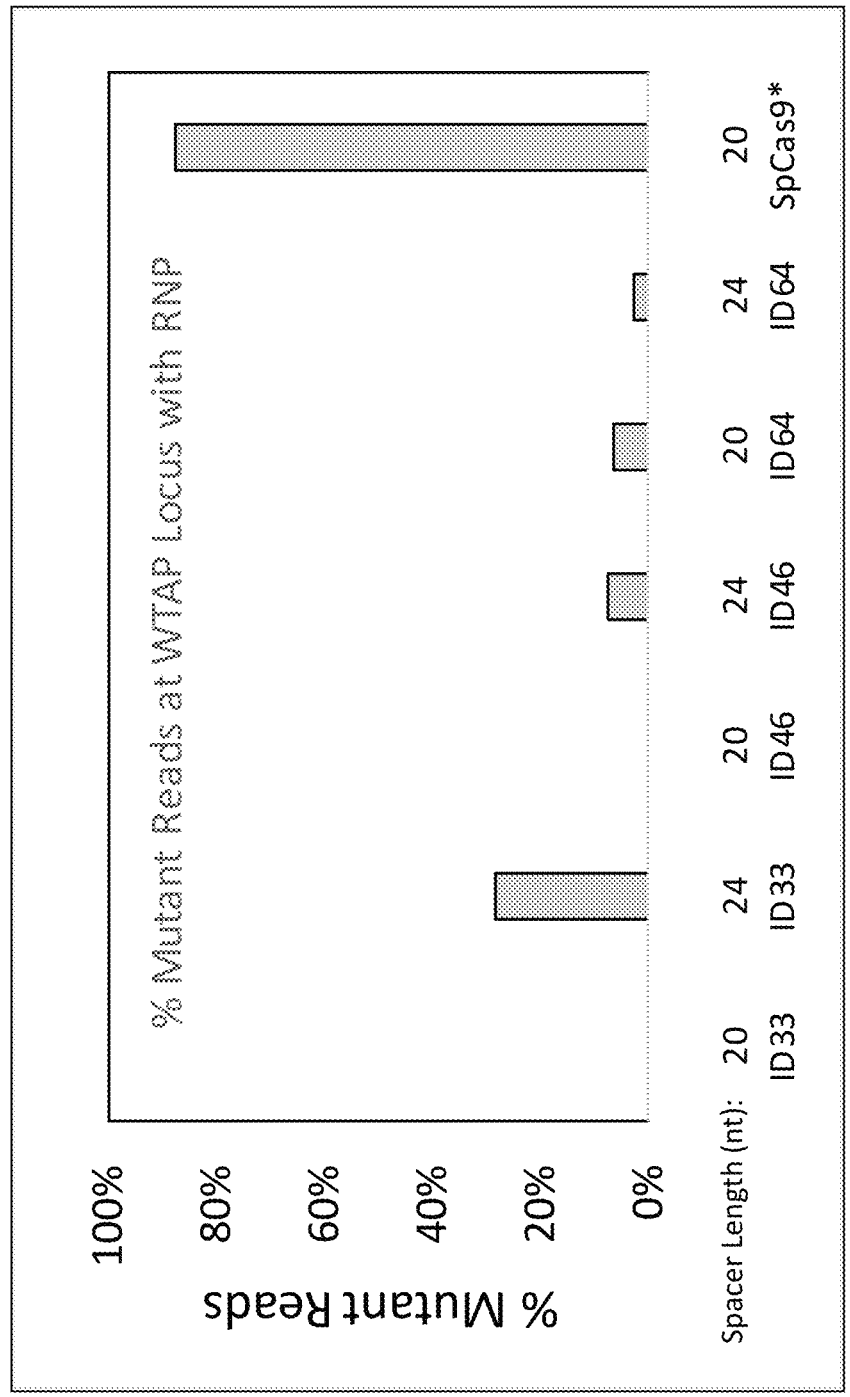

FIG. 20 shows the results of selected Cas9 orthologs at the HEK cell WTAP locus, as compared to the activity of *S. pyogenes* Cas9, in cells transformed with ribonucleoprotein comprising the respective Cas9 ortholog and its appropriate guide RNA.

Figure 21:
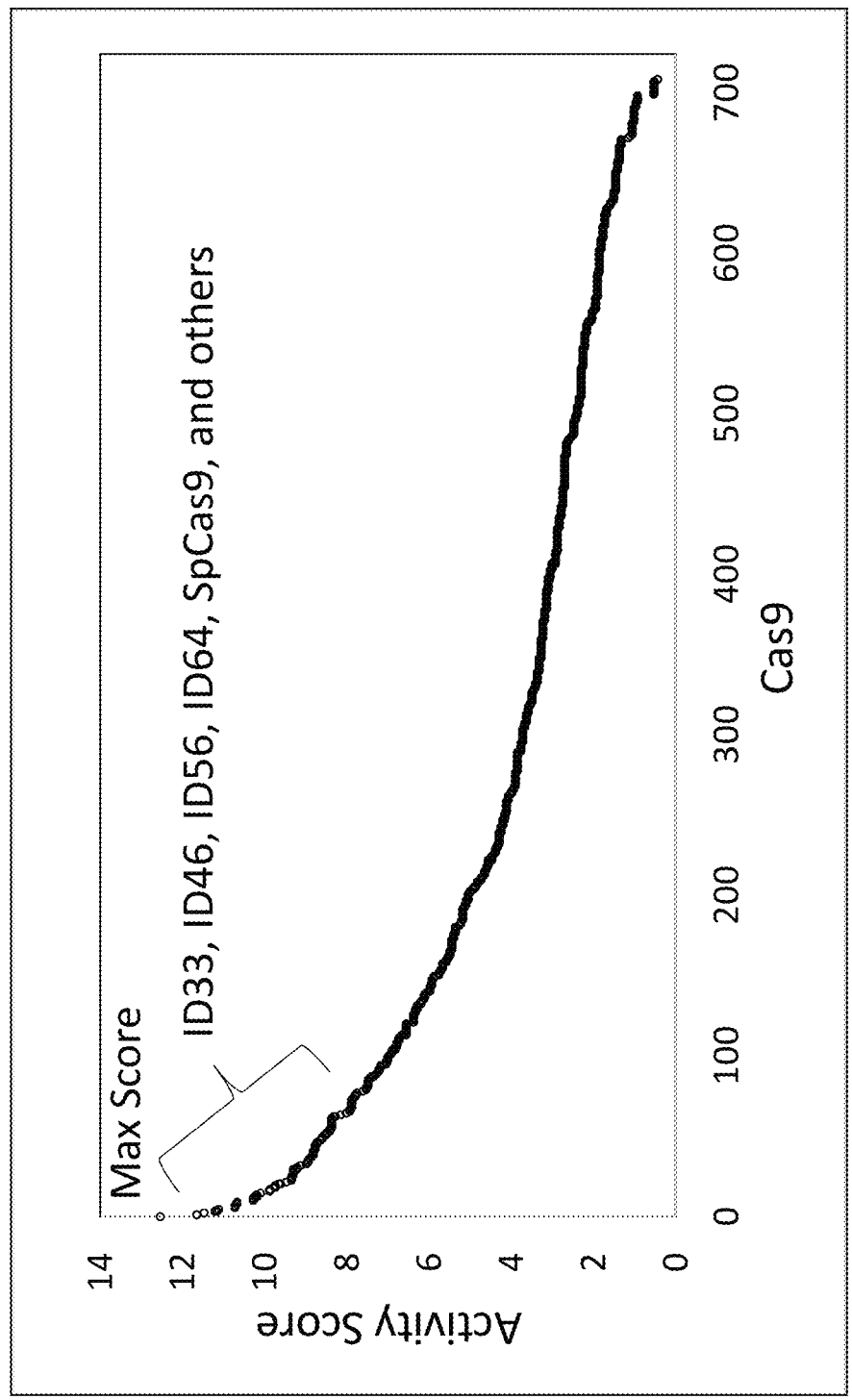

FIG. 21 shows the activity score plot of Cas9 orthologs, as described in Example 9.

SEQUENCES

SEQ ID NOs: 1-85 are the polynucleotide sequences encoding the Cas9 ortholog sequences SEQ IDs 86-170, respectively, with the Cas9 Ortholog ID numbers, source organisms, and phylogeny Clades described in Table 1.

Figure 1:
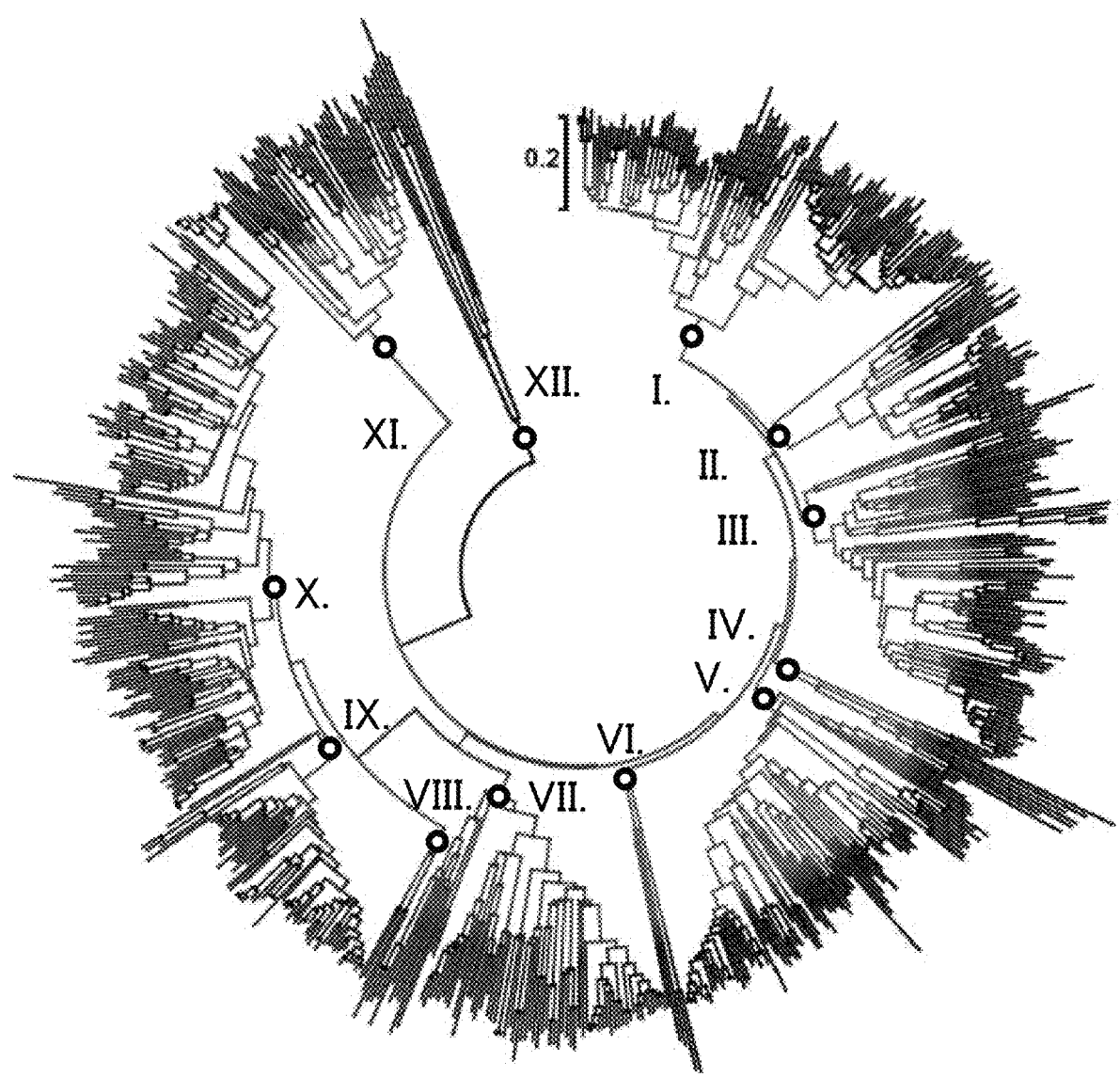
FIG. 1 is a graphical representation of the phylogram generated to identify the 12 clades described in Example 1.
Figure 2:
FIG. 2 depicts the secondary structure diagrams of the guide RNA molecules identified for some of the Cas9 orthologs of each of the 12 clades described in Example 1.

SEQ ID NOs:86-170 and 511-1135 are polypeptide sequences encoding the Cas9 orthologs represented in FIG. 1.

SEQ ID NOs:171-255 are the crRNA repeat sequences corresponding to the Cas9 orthologs of SEQ IDs 86-170, respectively.

SEQ ID NOs:256-340 are the anti-repeat sequences corresponding to the Cas9 orthologs of SEQ IDs 86-170, respectively.

SEQ ID NOs:341-425 are the 3' tracrRNA sequences corresponding to the Cas9 orthologs of SEQ IDs 86-170, respectively.

SEQ ID NOs:426-510 are the CER domains of the sgRNAs sequences corresponding to the Cas9 orthologs of SEQ IDs 86-170, respectively.

SEQ ID NOs:1136-1220 are the protein sequences of the REC domains for the Cas9 ortholog ID numbers listed in Table 2B.

SEQ ID NOs:1221-1305 are the protein sequences of the RUVC1 domains for the Cas9 ortholog ID numbers listed in Table 2B.

SEQ ID NOs:1306-1390 are the protein sequences of the RUVC2 domains for the Cas9 ortholog ID numbers listed in Table 2B.

SEQ ID NOs:1391-1475 are the protein sequences of the RUVC3 domains for the Cas9 ortholog ID numbers listed in Table 2B.

SEQ ID NOs:1476-1560 are the protein sequences of the HNH domains for the Cas9 ortholog ID numbers listed in Table 2B.

SEQ ID NOs:1561-1645 are the protein sequences of the WED domains for the Cas9 ortholog ID numbers listed in Table 2B.

SEQ ID NOs:1646-1730 are the protein sequences of the PI domains for the Cas9 ortholog ID numbers listed in Table 2B.

SEQ ID NO:1731 is the DNA sequence for Adapter A1.
SEQ ID NO:1732 is the DNA sequence for Adapter A2.
SEQ ID NO:1733 is the DNA sequence for R0 primer.
SEQ ID NO:1734 is the DNA sequence for C0 primer.
SEQ ID NO:1735 is the DNA sequence for F1 primer.
SEQ ID NO:1736 is the DNA sequence for R1 primer.
SEQ ID NO:1737 is the DNA sequence for 5' end bridge amplification sequence.
SEQ ID NO:1738 is the DNA sequence for 3' end bridge amplification sequence.
SEQ ID NO:1739 is the DNA sequence for F2 primer.
SEQ ID NO:1740 is the DNA sequence for R2 primer.
SEQ ID NO:1741 is the DNA sequence for C1 primer.
SEQ ID NO:1742 is the DNA sequence for a sequence product.
SEQ ID NO:1743 is the DNA sequence for an adapter and target.
SEQ ID NO:1744 is the DNA sequence for a 5' sequence upstream of the PAM.
SEQ ID NOs: 1746 is the DNA target sequence for the ID33 WT cleavage pattern.
SEQ ID NOs: 1747-1766 are the top 20 target sequence cleavage patterns for ID33.
SEQ ID NOs: 1767 is the DNA target sequence for the ID64 WT cleavage pattern.
SEQ ID NOs: 1768-1787 are the top 20 target sequence cleavage patterns for ID64.
SEQ ID NOs: 1788 is the DNA target sequence for the ID46 WT cleavage pattern.
SEQ ID NOs: 1789-1808 are the top 20 target sequence cleavage patterns for ID46.
SEQ ID NOs: 1809 is the DNA target sequence for the ID56 WT cleavage pattern.
SEQ ID NOs: 1810-1829 are the top 20 target sequence cleavage patterns for ID56.

DETAILED DESCRIPTION

Compositions are provided for novel Cas9 systems and elements comprising such systems, including, but not limiting to, novel guide polynucleotide/Cas endonucleases complexes, single guide RNAs, guide RNA elements, and Cas9 endonucleases. The present disclosure further includes compositions and methods for genome modification of a target sequence in the genome of a cell, for gene editing, and for inserting a polynucleotide of interest into the genome of a cell.

Compositions and methods are also provided for direct delivery of endonucleases, Cas proteins, guide RNAs and guide RNA/endonuclease complexes. The present disclosure further includes compositions and methods for genome modification of a target sequence in the genome of a cell, for gene editing, and for inserting a polynucleotide of interest into the genome of a cell.

Compositions and methods are also provided for in vitro characterization and modification of an isolated polynucleotide.

Given the diversity of Type II CRISPR-Cas systems (Fonfara et al. (2014) Nucleic Acids Res. 42:2577-2590), it is plausible that many of the Cas9 endonucleases and cognate guide RNAs may have unique sequence recognition and enzymatic properties different from those previously described or characterized. For example, cleavage activity and specificity may be enhanced or proto-spacer adjacent motif (PAM) sequence may be different leading to increased genomic target site density. To tap into this vast unexplored diversity and expand the repertoire of Cas9 endonucleases and cognate guide RNAs available for genome targeting, the two components of Cas9 target site recognition, the PAM sequence and the guide RNA (either duplexed CRISPR RNA (crRNA) and trans-activating CRISPR RNA (tracrRNA) or chimeric fusion of crRNA and tracrRNA (single guide RNA (sgRNA), need to be established for each new system.

As described herein, CRISPR-Cas loci (including Cas9 genes and open reading frames, CRISPR array and anti-repeats) from uncharacterized CRISPR-Cas systems were identified by searching internal Pioneer-DuPont databases consisting of microbial genomes. The Cas9 endonuclease described herein can be expressed and purified by methods known in the art. As described herein, the transcriptional direction of the tracrRNA for all the CRISPR-Cas systems can be deduced and examples of sgRNAs and its components (Variable Targeting domain (VT)), crRNA repeat, loop, anti-repeat and 3'tracrRNA) were identified for each new diverse CRISPR-Cas endonuclease described herein.

Terms used in the claims and specification are defined as set forth below unless otherwise specified. It must be noted that, as used in the specification and the appended claims, the singular forms "a," "an" and "the" include plural referents unless the context clearly dictates otherwise.

Definitions

As used herein, "nucleic acid" means a polynucleotide and includes a single or a double-stranded polymer of deoxyribonucleotide or ribonucleotide bases. Nucleic acids may also include fragments and modified nucleotides. Thus, the terms "polynucleotide", "nucleic acid sequence", "nucleotide sequence" and "nucleic acid fragment" are used interchangeably to denote a polymer of RNA and/or DNA and/or RNA-DNA that is single- or double-stranded, optionally comprising synthetic, non-naturally occurring, or altered nucleotide bases. Nucleotides (usually found in their 5'-monophosphate form) are referred to by their single letter designation as follows: "A" for adenosine or deoxyadenosine (for RNA or DNA, respectively), "C" for cytosine or deoxycytosine, "G" for guanosine or deoxyguanosine, "U" for uridine, "T" for deoxythymidine, "R" for purines (A or G), "Y" for pyrimidines (C or T), "K" for G or T, "H" for A or C or T, "I" for inosine, and "N" for any nucleotide.

The term "genome" as it applies to a prokaryotic and eukaryotic cell or organism cells encompasses not only chromosomal DNA found within the nucleus, but organelle DNA found within subcellular components (e.g., mitochondria, or plastid) of the cell.

"Open reading frame" is abbreviated ORF.

The term "selectively hybridizes" or "selective hybridization" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a polynucleotide/probe will selectively hybridize to its target sequence in an in vitro hybridization assay. Stringent conditions are sequence-dependent and will be different in different circumstances. By controlling the stringency of the hybridization and/or washing conditions, target sequences can be identified which are 100% complementary to the polynucleotide/probe (homologous probing). Alternatively, stringency conditions can be adjusted to allow some mismatching in sequences so that lower degrees of similarity are detected (heterologous probing). Generally, a polynucleotide/probe is fewer than about 1000 nucleotides in length, fewer than 500 nucleotides, fewer than 100 nucleotides, fewer than 90 nucleotides, fewer than 80 nucleotides, fewer than 70 nucleotides, fewer than 60 nucleotides, fewer than 50 nucleotides, fewer than 40 nucleotides, fewer than 30 nucleotides, fewer than 20 nucleotides, 10 nucleotides, or even fewer than 10 nucleotides. Typically, stringent conditions will be those in which the salt concentration is less than about 1.5 M Na ion, typically about 0.01 to 1.0 M Na ion concentration (or other salt(s)) at pH 7.0 to 8.3, and at least 30° C. for short polynucleotides/probes (e.g., 10 to 50 nucleotides) and at least 60° C. for long polynucleotides/probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

By "homology" is meant DNA sequences that are similar. For example, a "region of homology to a genomic region" that is found on the donor DNA is a region of DNA that has a similar sequence to a given "genomic region" in the cell or organism genome. A region of homology can be of any length that is sufficient to promote homologous recombination at the cleaved target site. For example, the region of homology can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800, 5-2900, 5-3000, 5-3100 or more bases in length such that the region of homology has sufficient similarity to undergo homologous recombination with the corresponding genomic region. "Sufficient similarity" indicates that two polynucleotide sequences have sufficient structural equivalency to act as substrates for a homologous recombination reaction. The structural equivalency includes overall length of each polynucleotide fragment, as well as the sequence similarity of the polynucleotides. Sequence similarity can be described by the percent sequence identity over the whole length of the sequences, and/or by conserved regions comprising localized similarities such as contiguous nucleotides having 100% sequence identity, and percent sequence identity over a portion of the length of the sequences.

As used herein, a "genomic region" is a segment of a chromosome in the genome of a cell that is present on either side of a target site or, alternatively, also comprises a portion of a target site. The genomic region can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800. 5-2900, 5-3000, 5-3100 or more bases such that the genomic region has sufficient similarity to undergo homologous recombination with the corresponding region of homology.

As used herein, "homologous recombination" (HR) includes the exchange of DNA fragments between two DNA molecules at the sites of homology. The frequency of homologous recombination is influenced by a number of factors. Different organisms vary with respect to the amount of homologous recombination and the relative proportion of homologous to non-homologous recombination. Generally, the length of the region of homology affects the frequency of homologous recombination events: the longer the region of homology, the greater the frequency. The length of the homology region needed to observe homologous recombination is also species-variable. In many cases, at least 5 kb of homology has been utilized, but homologous recombination has been observed with as little as 25-50 bp of homology. See, for example, Singer et al., (1982) *Cell* 31:25-33; Shen and Huang, (1986) Genetics 112:441-57; Watt et al., (1985) *Proc. Natl. Acad. Sci. USA* 82:4768-72, Sugawara and Haber, (1992) *Mol Cell Biol* 12:563-75, Rubnitz and Subramani, (1984) *Mol Cell Biol* 4:2253-8; Ayares et al., (1986) *Proc. Natl. Acad. Sci. USA* 83:5199-203; Liskay et al., (1987) *Genetics* 115:161-7.

"Sequence identity" or "identity" in the context of nucleic acid or polypeptide sequences refers to the nucleic acid bases or amino acid residues in two sequences that are the same when aligned for maximum correspondence over a specified comparison window.

The term "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, 95%, 96%, 97%, 98%, 99%, 100%, or any incremental or fractional percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, WI). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, (1989) *CABIOS* 5:151-153; Higgins et al., (1992) *Comput Appl Biosci* 8:189-191) and found in the MegAlign™ program of the LASERGENE bioinformatics computing suite (DNASTAR Inc., Madison, WI). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" Table in the same program. The "Clustal W method of alignment" corresponds to the alignment method labeled Clustal W (described by Higgins and Sharp, (1989) *CABIOS* 5:151-153; Higgins et al., (1992) *Comput Appl Biosci* 8:189-191) and found in the MegAlign™ v6.1 program of the LASERGENE bioinformatics computing suite (DNASTAR Inc., Madison, WI). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). Unless otherwise stated, sequence identity/similarity values provided herein refer to the value obtained using GAP Version 10 (GCG, Accelrys, San Diego, CA) using the following parameters: % identity and % similarity for a nucleotide sequence using a gap creation penalty weight of 50 and a gap length extension penalty weight of 3, and the nwsgapdna.cmp scoring matrix; % identity and % similarity for an amino acid sequence using a GAP creation penalty weight of 8 and a gap length extension penalty of 2, and the BLOSUM62 scoring matrix (Henikoff and Henikoff, (1989) *Proc. Natl. Acad. Sci. USA* 89:10915). GAP uses the algorithm of Needleman and Wunsch, (1970) *J Mol Biol* 48:443-53, to find an alignment of two complete sequences that maximizes the number of matches and minimizes the number of gaps. GAP considers all possible alignments and gap positions and creates the alignment with the largest number of matched bases and the fewest gaps, using a gap creation penalty and a gap extension penalty in units of matched bases. "BLAST" is a searching algorithm provided by the National Center for Biotechnology Information (NCBI) used to find regions of similarity between biological sequences. The program compares nucleotide or protein sequences to sequence databases and calculates the statistical significance of matches to identify sequences having sufficient similarity to a query sequence such that the similarity would not be predicted to have occurred randomly. BLAST reports the identified sequences and their local alignment to the query sequence. It is well understood by one skilled in the art that many levels of sequence identity are useful in identifying polypeptides from other species or modified naturally or synthetically wherein such polypeptides have the same or similar function or activity. Useful examples of percent identities include, but are not limited to, 50%, 55%, 60%, 65%, 70%, 75%, 80%, 85%, 90%, 95%, 96%, 97%, 98%, 99%, 100%, or any incremental or fractional percentage from 50% to 100%. Indeed, any amino acid identity from 50% to 100% may be useful in describing the present disclosure, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%.

Polynucleotide and polypeptide sequences, variants thereof, and the structural relationships of these sequences can be described by the terms "homology", "homologous", "substantially identical", "substantially similar" and "corresponding substantially" which are used interchangeably herein. These refer to polypeptide or nucleic acid sequences wherein changes in one or more amino acids or nucleotide bases do not affect the function of the molecule, such as the ability to mediate gene expression or to produce a certain phenotype. These terms also refer to modification(s) of nucleic acid sequences that do not substantially alter the functional properties of the resulting nucleic acid relative to the initial, unmodified nucleic acid. These modifications include deletion, substitution, and/or insertion of one or more nucleotides in the nucleic acid fragment, or the association of an atom or a molecule to an existing nucleotide in a polynucleotide (for example but not limited to: a covalent addition of a methyl group, or an ionic interaction with a metal ion). Substantially similar nucleic acid sequences encompassed may be defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

A "centimorgan" (cM) or "map unit" is the distance between two polynucleotide sequences, linked genes, markers, target sites, loci, or any pair thereof, wherein 1% of the products of meiosis are recombinant. Thus, a centimorgan is equivalent to a distance equal to a 1% average recombination frequency between the two linked genes, markers, target sites, loci, or any pair thereof.

An "isolated" or "purified" nucleic acid molecule, polynucleotide, polypeptide, or protein, or biologically active portion thereof, is substantially or essentially free from components that normally accompany or interact with the polynucleotide or protein as found in its naturally occurring environment. Thus, an isolated or purified polynucleotide or polypeptide or protein is substantially free of other cellular material, or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. Isolated polynucleotides may be purified from a cell in which they naturally occur. Conventional nucleic acid purification methods known to skilled artisans may be used to obtain isolated polynucleotides. The term also embraces recombinant polynucleotides and chemically synthesized polynucleotides.

The term "fragment" refers to a contiguous set of polynucleotides or polypeptides. In one embodiment, a fragment is 2, 3, 4, 5, 6, 7 8, 9, 10, 11, 12, 13, 14, 15, 16, 17, 18, 19, 20, or greater than 20 contiguous polynucleotides. In one embodiment, a fragment is 2, 3, 4, 5, 6, 7 8, 9, 10, 11, 12, 13, 14, 15, 16, 17, 18, 19, 20, or greater than 20 contiguous polypeptides. A fragment may or may not exhibit the function of a sequence sharing some percent identity over the length of said fragment.

The terms "fragment that is functionally equivalent" and "functionally equivalent fragment" are used interchangeably herein. These terms refer to a portion or subsequence of an isolated nucleic acid fragment or polypeptide that displays the same activity or function as the longer sequence from which it derives. In one example, the fragment retains the ability to alter gene expression or produce a certain phenotype whether or not the fragment encodes an active protein. For example, the fragment can be used in the design of genes to produce the desired phenotype in a modified plant. Genes can be designed for use in suppression by linking a nucleic acid fragment, whether or not it encodes an active enzyme, in the sense or antisense orientation relative to a promoter sequence.

"Gene" includes a nucleic acid fragment that expresses a functional molecule such as, but not limited to, a specific protein, including regulatory sequences preceding (5' non-coding sequences) and following (3' non-coding sequences) the coding sequence. "Native gene" refers to a gene as found in its natural endogenous location with its own regulatory sequences.

By the term "endogenous" it is meant a sequence or other molecule that naturally occurs in a cell or organism. In one aspect, an endogenous polynucleotide is normally found in the genome of the cell from which it is obtained; that is, not heterologous.

An "allele" is one of several alternative forms of a gene occupying a given locus on a chromosome. When all the alleles present at a given locus on a chromosome are the same, that plant is homozygous at that locus. If the alleles present at a given locus on a chromosome differ, that plant is heterozygous at that locus.

"Coding sequence" refers to a polynucleotide sequence that may be transcribed into an RNA molecule and optionally further translated into a polypeptide. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences include, but are not limited to, promoters, translation leader sequences, 5' untranslated sequences, 3' untranslated sequences, introns, polyadenylation target sequences, RNA processing sites, effector binding sites, and stem-loop structures.

A "mutated gene" is a gene that has been altered through human intervention. Such a "mutated gene" has a sequence that differs from the sequence of the corresponding non-mutated gene by at least one nucleotide addition, deletion, or substitution. In certain embodiments of the disclosure, the mutated gene comprises an alteration that results from a guide polynucleotide/Cas endonuclease system as disclosed herein. A mutated plant is a plant comprising a mutated gene.

As used herein, a "targeted mutation" is a mutation in a gene (referred to as the target gene), including a native gene, that was made by altering a target sequence within the target gene using any method known to one skilled in the art, including a method involving a guided Cas endonuclease system as disclosed herein.

The terms "knock-out", "gene knock-out" and "genetic knock-out" are used interchangeably herein. A knock-out represents a DNA sequence of a cell that has been rendered partially or completely inoperative by targeting with a Cas protein; for example, a DNA sequence prior to knock-out could have encoded an amino acid sequence, or could have had a regulatory function (e.g., promoter).

The terms "knock-in", "gene knock-in, "gene insertion" and "genetic knock-in" are used interchangeably herein. A knock-in represents the replacement or insertion of a DNA sequence at a specific DNA sequence in cell by targeting with a Cas protein (for example by homologous recombination (HR), wherein a suitable donor DNA polynucleotide is also used). Examples of knock-ins are a specific insertion of a heterologous amino acid coding sequence in a coding region of a gene, or a specific insertion of a transcriptional regulatory element in a genetic locus.

By "domain" it is meant a contiguous stretch of nucleotides (that can be RNA, DNA, and/or RNA-DNA-combination sequence) or amino acids.

The term "conserved domain" or "motif" means a set of polynucleotides or amino acids conserved at specific positions along an aligned sequence of evolutionarily related proteins. While amino acids at other positions can vary between homologous proteins, amino acids that are highly conserved at specific positions indicate amino acids that are essential to the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

A "codon-modified gene" or "codon-preferred gene" or "codon-optimized gene" is a gene having its frequency of codon usage designed to mimic the frequency of preferred codon usage of the host cell.

An "optimized" polynucleotide is a sequence that has been optimized for improved expression or function in a particular heterologous host cell.

A "plant-optimized nucleotide sequence" is a nucleotide sequence that has been optimized for expression or function in plants, particularly for increased expression in plants. A plant-optimized nucleotide sequence includes a codon-optimized gene. A plant-optimized nucleotide sequence can be synthesized by modifying a nucleotide sequence encoding a protein such as, for example, a Cas endonuclease as disclosed herein, using one or more plant-preferred codons for improved expression. See, for example, Campbell and Gowri (1990) *Plant Physiol.* 92:1-11 for a discussion of host-preferred codon usage.

A "promoter" is a region of DNA involved in recognition and binding of RNA polymerase and other proteins to initiate transcription. The promoter sequence consists of proximal and more distal upstream elements, the latter elements often referred to as enhancers. An "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, and/or comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity.

Promoters that cause a gene to be expressed in most cell types at most times are commonly referred to as "constitutive promoters". The term "inducible promoter" refers to a promoter that selectively express a coding sequence or functional RNA in response to the presence of an endogenous or exogenous stimulus, for example by chemical compounds (chemical inducers) or in response to environmental, hormonal, chemical, and/or developmental signals. Inducible or regulated promoters include, for example, promoters induced or regulated by light, heat, stress, flooding or drought, salt stress, osmotic stress, phytohormones, wounding, or chemicals such as ethanol, abscisic acid (ABA), jasmonate, salicylic acid, or safeners.

"Translation leader sequence" refers to a polynucleotide sequence located between the promoter sequence of a gene and the coding sequence. The translation leader sequence is present in the mRNA upstream of the translation start sequence. The translation leader sequence may affect processing of the primary transcript to mRNA, mRNA stability or translation efficiency. Examples of translation leader sequences have been described (e.g., Turner and Foster, (1995) *Mol Biotechnol* 3:225-236).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al., (1989) *Plant Cell* 1:671-680.

"RNA transcript" refers to the product resulting from RNA polymerase-catalyzed transcription of a DNA sequence. When the RNA transcript is a perfect complimentary copy of the DNA sequence, it is referred to as the primary transcript or pre-mRNA. A RNA transcript is referred to as the mature RNA or mRNA when it is a RNA sequence derived from post-transcriptional processing of the primary transcript pre-mRNA. "Messenger RNA" or "mRNA" refers to the RNA that is without introns and that can be translated into protein by the cell. "cDNA" refers to a DNA that is complementary to, and synthesized from, an mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (see, e.g., U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated yet has an effect on cellular processes. The terms "complement" and "reverse complement" are used interchangeably herein with respect to mRNA transcripts, and are meant to define the antisense RNA of the message.

The term "genome" refers to the entire complement of genetic material (genes and non-coding sequences) that is present in each cell of an organism, or virus or organelle; and/or a complete set of chromosomes inherited as a (haploid) unit from one parent.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions can be operably linked, either directly or indirectly, 5' to the target mRNA, or 3' to the target mRNA, or within the target mRNA, or a first complementary region is 5' and its complement is 3' to the target mRNA.

Generally, "host" refers to an organism or cell into which a heterologous component (polynucleotide, polypeptide, other molecule, cell) has been introduced. As used herein, a "host cell" refers to an in vivo or in vitro eukaryotic cell, prokaryotic cell (e.g., bacterial or archaeal cell), or cell from a multicellular organism (e.g., a cell line) cultured as a unicellular entity, into which a heterologous polynucleotide or polypeptide has been introduced. In some embodiments, the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, in invertebrate cell, a vertebrate cell, a fish cell, a frog cell, a bird cell, an insect cell, a mammalian cell, a pig cell, a cow cell, a goat cell, a sheep cell, a rodent cell, a rat cell, a mouse cell, a non-human primate cell, and a human cell. In some cases, the cell is in vitro. In some cases, the cell is in vivo.

The term "recombinant" refers to an artificial combination of two otherwise separated segments of sequence, e.g., by chemical synthesis, or manipulation of isolated segments of nucleic acids by genetic engineering techniques.

The terms "plasmid", "vector" and "cassette" refer to a linear or circular extra chromosomal element often carrying genes that are not part of the central metabolism of the cell, and usually in the form of double-stranded DNA. Such elements may be autonomously replicating sequences, genome integrating sequences, phage, or nucleotide sequences, in linear or circular form, of a single- or double-stranded DNA or RNA, derived from any source, in which a number of nucleotide sequences have been joined or recombined into a unique construction which is capable of introducing a polynucleotide of interest into a cell. "Transformation cassette" refers to a specific vector comprising a gene and having elements in addition to the gene that facilitates transformation of a particular host cell. "Expression cassette" refers to a specific vector comprising a gene and having elements in addition to the gene that allow for expression of that gene in a host.

The terms "recombinant DNA molecule", "recombinant DNA construct", "expression construct", "construct", and "recombinant construct" are used interchangeably herein. A recombinant DNA construct comprises an artificial combination of nucleic acid sequences, e.g., regulatory and coding sequences that are not all found together in nature. For example, a recombinant DNA construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to introduce the vector into the host cells as is well known to those skilled in the art. For example, a plasmid vector can be used. The skilled artisan is well aware of the genetic elements that must be present on the vector in order to successfully transform, select and propagate host cells. The skilled artisan will also recognize that different independent transformation events may result in different levels and patterns of expression (Jones et al., (1985) *EMBO J* 4:2411-2418; De Almeida et al., (1989) *Mol Gen Genetics* 218:78-86), and thus that multiple events are typically screened in order to obtain lines displaying the desired expression level and pattern. Such screening may be accomplished standard molecular biological, biochemical, and other assays including Southern analysis of DNA, Northern analysis of mRNA expression, PCR, real time quantitative PCR (qPCR), reverse transcription PCR (RT-PCR), immunoblotting analysis of protein expression, enzyme or activity assays, and/or phenotypic analysis.

The term "heterologous" refers to the difference between the original environment, location, or composition of a particular polynucleotide or polypeptide sequence and its current environment, location, or composition. Non-limiting examples include differences in taxonomic derivation (e.g., a polynucleotide sequence obtained from *Zea mays* would be heterologous if inserted into the genome of an *Oryza sativa* plant, or of a different variety or cultivar of *Zea mays*; or a polynucleotide obtained from a bacterium was introduced into a cell of a plant), or sequence (e.g., a polynucleotide sequence obtained from *Zea mays*, isolated, modified, and re-introduced into a maize plant). As used herein, "heterologous" in reference to a sequence can refer to a sequence that originates from a different species, variety, foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide. Alternatively, one or more regulatory region(s) and/or a polynucleotide provided herein may be entirely synthetic.

The term "expression", as used herein, refers to the production of a functional end-product (e.g., an mRNA, guide RNA, or a protein) in either precursor or mature form.

A "mature" protein refers to a post-translationally processed polypeptide (i.e., one from which any pre- or propeptides present in the primary translation product have been removed).

"Precursor" protein refers to the primary product of translation of mRNA (i.e., with pre- and propeptides still present). Pre- and propeptides may be but are not limited to intracellular localization signals.

"CRISPR" (Clustered Regularly Interspaced Short Palindromic Repeats) loci refers to certain genetic loci encoding components of DNA cleavage systems, for example, used by bacterial and archaeal cells to destroy foreign DNA (Horvath and Barrangou, 2010, *Science* 327:167-170; WO2007025097, published 1 Mar. 2007). A CRISPR locus can consist of a CRISPR array, comprising short direct repeats (CRISPR repeats) separated by short variable DNA sequences (called spacers), which can be flanked by diverse Cas (CRISPR-associated) genes.

As used herein, an "effector" or "effector protein" is a protein that encompasses an activity including recognizing, binding to, and/or cleaving or nicking a polynucleotide target. The "effector complex" of a CRISPR system includes Cas proteins involved in crRNA and target recognition and binding. Some of the component Cas proteins may additionally comprise domains involved in target polynucleotide cleavage.

The term "Cas protein" refers to a polypeptide encoded by a Cas (CRISPR-associated) gene. A Cas protein includes but is not limited to: the novel Cas9 orthologs disclosed herein, a Cas9 protein, a Cpf1 (Cas12) protein, a C2c1 protein, a C2c2 protein, a C2c3 protein, Cas3, Cas3-HD, Cas 5, Cas7, Cas8, Cas10, or combinations or complexes of these. A Cas protein may be a "Cas endonuclease", that when in complex with a suitable polynucleotide component, is capable of recognizing, binding to, and optionally nicking or cleaving all or part of a specific polynucleotide target sequence. A Cas endonuclease described herein comprises one or more nuclease domains. A Cas protein is further defined as a functional fragment or functional variant of a native Cas protein, or a protein that shares at least 50%, between 50% and 55%, at least 55%, between 55% and 60%, at least 60%, between 60% and 65%, at least 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, or greater than 500 contiguous amino acids of a native Cas protein, and retains at least partial activity.

A "functional fragment", "fragment that is functionally equivalent" and "functionally equivalent fragment" of a Cas endonuclease are used interchangeably herein, and refer to a portion or subsequence of the Cas endonuclease of the present disclosure in which the ability to recognize, bind to, and optionally unwind, nick or cleave (introduce a single or double-strand break in) the target site is retained. The portion or subsequence of the Cas endonuclease can comprise a complete or partial (functional) peptide of any one of its domains such as for example, but not limiting to a complete or functional part of a HD domain, a complete or functional part of a helicase domain, a complete or functional part of an endonuclease domain, a complete or functional part of a PAM-interacting domain, a complete or functional part of a Wedge domain, a complete or functional part of an RuvC domain, a complete or functional part of a zinc-finger domain, or a complete or functional part of a Cas protein (such as but not limiting to a Cas9, Cpf1, Cas5, Cas5d, Cas7, Cas8b1, Cas1, Cas2, Cas4, or Cas9 ortholog).

The terms "functional variant", "variant that is functionally equivalent" and "functionally equivalent variant" of a Cas endonuclease or Cas endonuclease, including Cas9 ortholog described herein, are used interchangeably herein, and refer to a variant of the Cas endonuclease disclosed herein in which the ability to recognize, bind to, and optionally unwind, nick or cleave all or part of a target sequence is retained.

In some aspects, a functional fragment or functional variant retains about the same level and type (e.g., target polynucleotide recognition, binding, and cleavage) of activity as the parental molecule from which it was derived. In some aspects, a functional fragment or functional variant displays improved activity of the same type (e.g., increased specificity of target polynucleotide recognition) as the parental molecule from which it was derived. In some aspects, a functional fragment or functional variant displays reduced activity of the same type (e.g., lower target polynucleotide binding affinity) as the parental molecule from which it was derived. In some aspects, a functional fragment or functional variant displays partial activity (e.g. polynucleotide recognition and binding, but not cleavage) as the parental molecule from which it was derived. In some aspects, a functional fragment or functional variant displays a different type of activity (e.g., creation of a single-strand nick on a target polynucleotide vs. a double strand break) than the parental molecule from which it was derived. Any similarity or difference in type or level of activity may be chosen as a desired outcome, according to the needs of the practitioner.

A Cas endonuclease may also include a multifunctional Cas endonuclease. The term "multifunctional Cas endonuclease" and "multifunctional Cas endonuclease polypeptide" are used interchangeably herein and includes reference to a single polypeptide that has Cas endonuclease functionality (comprising at least one protein domain that can act as a Cas endonuclease) and at least one other functionality, such as but not limited to, the functionality to form a cascade (comprises at least a second protein domain that can form a cascade with other proteins). In one aspect, the multifunctional Cas endonuclease comprises at least one additional protein domain relative (either internally, upstream (5'), downstream (3'), or both internally 5' and 3', or any combination thereof) to those domains typical of a Cas endonuclease.

The terms "cascade" and "cascade complex" are used interchangeably herein and include reference to a multi-subunit protein complex that can assemble with a polynucleotide forming a polynucleotide-protein complex (PNP). Cascade is a PNP that relies on the polynucleotide for complex assembly and stability, and for the identification of target nucleic acid sequences. Cascade functions as a surveillance complex that finds and optionally binds target nucleic acids that are complementary to a variable targeting domain of the guide polynucleotide.

The terms "cleavage-ready Cascade", "crCascade", "cleavage-ready Cascade complex", "crCascade complex", "cleavage-ready Cascade system", "CRC" and "crCascade system", are used interchangeably herein and include reference to a multi-subunit protein complex that can assemble with a polynucleotide forming a polynucleotide-protein complex (PNP), wherein one of the cascade proteins is a Cas endonuclease capable of recognizing, binding to, and optionally unwinding, nicking, or cleaving all or part of a target sequence.

The terms "5'-cap" and "7-methylguanylate (m7G) cap" are used interchangeably herein. A 7-methylguanylate residue is located on the 5' terminus of messenger RNA (mRNA) in eukaryotes. RNA polymerase II (Pol II) transcribes mRNA in eukaryotes. Messenger RNA capping occurs generally as follows: The most terminal 5' phosphate group of the mRNA transcript is removed by RNA terminal phosphatase, leaving two terminal phosphates. A guanosine monophosphate (GMP) is added to the terminal phosphate of the transcript by a guanylyl transferase, leaving a 5'-5' triphosphate-linked guanine at the transcript terminus. Finally, the 7-nitrogen of this terminal guanine is methylated by a methyl transferase.

The terminology "not having a 5'-cap" herein is used to refer to RNA having, for example, a 5'-hydroxyl group instead of a 5'-cap. Such RNA can be referred to as "uncapped RNA", for example. Uncapped RNA can better accumulate in the nucleus following transcription, since 5'-capped RNA is subject to nuclear export. One or more RNA components herein are uncapped.

As used herein, the term "guide polynucleotide", relates to a polynucleotide sequence that can form a complex with a Cas endonuclease, including the Cas endonuclease described herein, and enables the Cas endonuclease to recognize, optionally bind to, and optionally cleave a DNA target site. The guide polynucleotide sequence can be a RNA sequence, a DNA sequence, or a combination thereof (a RNA-DNA combination sequence).

The terms "functional fragment", "fragment that is functionally equivalent" and "functionally equivalent fragment" of a guide RNA, crRNA or tracrRNA are used interchangeably herein, and refer to a portion or subsequence of the guide RNA, crRNA or tracrRNA, respectively, of the present disclosure in which the ability to function as a guide RNA, crRNA or tracrRNA, respectively, is retained.

The terms "functional variant", "variant that is functionally equivalent" and "functionally equivalent variant" of a guide RNA, crRNA or tracrRNA (respectively) are used interchangeably herein, and refer to a variant of the guide RNA, crRNA or tracrRNA, respectively, of the present disclosure in which the ability to function as a guide RNA, crRNA or tracrRNA, respectively, is retained.

The terms "single guide RNA" and "sgRNA" are used interchangeably herein and relate to a synthetic fusion of two RNA molecules, a crRNA (CRISPR RNA) comprising a variable targeting domain (linked to a tracr mate sequence that hybridizes to a tracrRNA), fused to a tracrRNA (trans-activating CRISPR RNA). The single guide RNA can comprise a crRNA or crRNA fragment and a tracrRNA or tracrRNA fragment of the type II CRISPR/Cas system that can form a complex with a type II Cas endonuclease, wherein said guide RNA/Cas endonuclease complex can direct the Cas endonuclease to a DNA target site, enabling the Cas endonuclease to recognize, optionally bind to, and optionally nick or cleave (introduce a single or double-strand break) the DNA target site.

The term "variable targeting domain" or "VT domain" is used interchangeably herein and includes a nucleotide sequence that can hybridize (is complementary) to one strand (nucleotide sequence) of a double strand DNA target site. The percent complementation between the first nucleotide sequence domain (VT domain) and the target sequence can be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable targeting domain can be at least 12, 13, 14, 15, 16, 17, 18, 19, 20, 21, 22, 23, 24, 25, 26, 27, 28, 29 or 30 nucleotides in length. In some embodiments, the variable targeting domain comprises a contiguous stretch of 12 to 30 nucleotides. The variable targeting domain can be composed of a DNA sequence, a RNA sequence, a modified DNA sequence, a modified RNA sequence, or any combination thereof.

The term "Cas endonuclease recognition domain" or "CER domain" (of a guide polynucleotide) is used interchangeably herein and includes a nucleotide sequence that interacts with a Cas endonuclease polypeptide. A CER domain comprises a (trans-acting) tracrNucleotide mate sequence followed by a tracrNucleotide sequence. The CER domain can be composed of a DNA sequence, a RNA sequence, a modified DNA sequence, a modified RNA sequence (see for example US20150059010A1, published 26 Feb. 2015), or any combination thereof.

As used herein, the terms "guide polynucleotide/Cas endonuclease complex", "guide polynucleotide/Cas endonuclease system", "guide polynucleotide/Cas complex", "guide polynucleotide/Cas system" and "guided Cas system" "polynucleotide-guided endonuclease", and "PGEN" are used interchangeably herein and refer to at least one guide polynucleotide and at least one Cas endonuclease, that are capable of forming a complex, wherein said guide polynucleotide/Cas endonuclease complex can direct the Cas endonuclease to a DNA target site, enabling the Cas endonuclease to recognize, bind to, and optionally nick or cleave (introduce a single or double-strand break) the DNA target site. A guide polynucleotide/Cas endonuclease complex herein can comprise Cas protein(s) and suitable polynucleotide component(s) of any of the known CRISPR systems (Horvath and Barrangou, 2010, *Science* 327:167-170; Makarova et al. 2015, *Nature Reviews Microbiology* Vol. 13:1-15; Zetsche et al., 2015, Cell 163, 1-13; Shmakov et al., 2015, *Molecular Cell* 60, 1-13).

The terms "guide RNA/Cas endonuclease complex", "guide RNA/Cas endonuclease system", "guide RNA/Cas complex", "guide RNA/Cas system", "gRNA/Cas complex", "gRNA/Cas system", "RNA-guided endonuclease", and "RGEN" are used interchangeably herein and refer to at least one RNA component and at least one Cas endonuclease that are capable of forming a complex, wherein said guide RNA/Cas endonuclease complex can direct the Cas endonuclease to a DNA target site, enabling the Cas endonuclease to recognize, bind to, and optionally nick or cleave (introduce a single or double-strand break) the DNA target site. In some aspects, the components are provided as a ribonucleoprotein complex ("RNP") of a Cas endonuclease protein and a guide RNA.

The terms "target site", "target sequence", "target site sequence, "target DNA", "target locus", "genomic target site", "genomic target sequence", "genomic target locus" and "protospacer", are used interchangeably herein and refer to a polynucleotide sequence such as, but not limited to, a nucleotide sequence on a chromosome, episome, a locus, or any other DNA molecule in the genome (including chromosomal, chloroplastic, mitochondrial DNA, plasmid DNA) of a cell, at which a guide polynucleotide/Cas endonuclease complex can recognize, bind to, and optionally nick or cleave. The target site can be an endogenous site in the genome of a cell, or alternatively, the target site can be heterologous to the cell and thereby not be naturally occurring in the genome of the cell, or the target site can be found in a heterologous genomic location compared to where it occurs in nature. As used herein, terms "endogenous target sequence" and "native target sequence" are used interchangeable herein to refer to a target sequence that is endogenous or native to the genome of a cell and is at the endogenous or native position of that target sequence in the genome of the cell. An "artificial target site" or "artificial target sequence" are used interchangeably herein and refer to a target sequence that has been introduced into the genome of a cell. Such an artificial target sequence can be identical in sequence to an endogenous or native target sequence in the genome of a cell but be located in a different position (i.e., a non-endogenous or non-native position) in the genome of a cell.

A "protospacer adjacent motif" (PAM) herein refers to a short nucleotide sequence adjacent to a target sequence (protospacer) that is recognized (targeted) by a guide polynucleotide/Cas endonuclease system described herein. In some aspects, the Cas endonuclease may not successfully recognize a target DNA sequence if the target DNA sequence is not adjacent to, or near, a PAM sequence. In some aspects, the PAM precedes the target sequence (e.g. Cas12a). In some aspects, the PAM follows the target sequence (e.g. *S. pyogenes* Cas9). The sequence and length of a PAM herein can differ depending on the Cas protein or Cas protein complex used. The PAM sequence can be of any length but is typically 1, 2, 3, 4, 5, 6, 7, 8, 9, 10, 11, 12, 13, 14, 15, 16, 17, 18, 19 or 20 nucleotides long.

An "altered target site", "altered target sequence", "modified target site", "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

A "modified nucleotide" or "edited nucleotide" refers to a nucleotide sequence of interest that comprises at least one alteration when compared to its non-modified nucleotide sequence. Such "alterations" include, for example: (i) replacement of at least one nucleotide, (ii) a deletion of at least one nucleotide, (iii) an insertion of at least one nucleotide, or (iv) any combination of (i)-(iii).

Methods for "modifying a target site" and "altering a target site" are used interchangeably herein and refer to methods for producing an altered target site.

As used herein, "donor DNA" is a DNA construct that comprises a polynucleotide of interest to be inserted into the target site of a Cas endonuclease.

The term "polynucleotide modification template" includes a polynucleotide that comprises at least one nucleotide modification when compared to the nucleotide sequence to be edited. A nucleotide modification can be at least one nucleotide substitution, addition or deletion. Optionally, the polynucleotide modification template can further comprise homologous nucleotide sequences flanking the at least one nucleotide modification, wherein the flanking homologous nucleotide sequences provide sufficient homology to the desired nucleotide sequence to be edited.

The term "plant-optimized Cas endonuclease" herein refers to a Cas protein, including a multifunctional Cas protein, encoded by a nucleotide sequence that has been optimized for expression in a plant cell or plant.

A "plant-optimized nucleotide sequence encoding a Cas endonuclease", "plant-optimized construct encoding a Cas endonuclease" and a "plant-optimized polynucleotide encoding a Cas endonuclease" are used interchangeably herein and refer to a nucleotide sequence encoding a Cas protein, or a variant or functional fragment thereof, that has been optimized for expression in a plant cell or plant.

The term "plant" generically includes whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores. A "plant element" is intended to reference either a whole plant or a plant component, which may comprise differentiated and/or undifferentiated tissues, for example but not limited to plant tissues, parts, and cell types. In one embodiment, a plant element is one of the following: whole plant, seedling, meristematic tissue, ground tissue, vascular tissue, dermal tissue, seed, leaf, root, shoot, stem, flower, fruit, stolon, bulb, tuber, corm, keiki, shoot, bud, tumor tissue, and various forms of cells and culture (e.g., single cells, protoplasts, embryos, callus tissue). The term "plant organ" refers to plant tissue or a group of tissues that constitute a morphologically and functionally distinct part of a plant. As used herein, a "plant element" is synonymous to a "portion" of a plant, and refers to any part of the plant, and can include distinct tissues and/or organs, and may be used interchangeably with the term "tissue" throughout. Similarly, a "plant reproductive element" is intended to generically reference any part of a plant that is able to initiate other plants via either sexual or asexual reproduction of that plant, for example but not limited to: seed, seedling, root, shoot, cutting, scion, graft, stolon, bulb, tuber, corm, keiki, or bud. The plant element may be in plant or in a plant organ, tissue culture, or cell culture.

"Progeny" comprises any subsequent generation of a plant.

As used herein, the term "plant part" refers to plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like, as well as the parts themselves. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

The term "monocotyledonous" or "monocot" refers to the subclass of angiosperm plants also known as "monocotyledoneae", whose seeds typically comprise only one embryonic leaf, or cotyledon. The term includes references to whole plants, plant elements, plant organs (e.g., leaves, stems, roots, etc.), seeds, plant cells, and progeny of the same.

The term "dicotyledonous" or "dicot" refers to the subclass of angiosperm plants also knows as "dicotyledoneae", whose seeds typically comprise two embryonic leaves, or cotyledons. The term includes references to whole plants, plant elements, plant organs (e.g., leaves, stems, roots, etc.), seeds, plant cells, and progeny of the same.

As used herein, a "male sterile plant" is a plant that does not produce male gametes that are viable or otherwise capable of fertilization. As used herein, a "female sterile plant" is a plant that does not produce female gametes that are viable or otherwise capable of fertilization. It is recognized that male-sterile and female-sterile plants can be female-fertile and male-fertile, respectively. It is further recognized that a male fertile (but female sterile) plant can produce viable progeny when crossed with a female fertile plant and that a female fertile (but male sterile) plant can produce viable progeny when crossed with a male fertile plant.

The term "non-conventional yeast" herein refers to any yeast that is not a *Saccharomyces* (e.g., *S. cerevisiae*) or *Schizosaccharomyces* yeast species. (see "Non-Conventional Yeasts in Genetics, Biochemistry and Biotechnology: Practical Protocols", K. Wolf, K. D. Breunig, G. Barth, Eds., Springer-Verlag, Berlin, Germany, 2003).

The term "crossed" or "cross" or "crossing" in the context of this disclosure means the fusion of gametes via pollination to produce progeny (i.e., cells, seeds, or plants). The term encompasses both sexual crosses (the pollination of one plant by another) and selfing (self-pollination, i.e., when the pollen and ovule (or microspores and megaspores) are from the same plant or genetically identical plants).

The term "introgression" refers to the transmission of a desired allele of a genetic locus from one genetic background to another. For example, introgression of a desired allele at a specified locus can be transmitted to at least one progeny plant via a sexual cross between two parent plants, where at least one of the parent plants has the desired allele within its genome. Alternatively, for example, transmission of an allele can occur by recombination between two donor genomes, e.g., in a fused protoplast, where at least one of the donor protoplasts has the desired allele in its genome. The desired allele can be, e.g., a transgene, a modified (mutated or edited) native allele, or a selected allele of a marker or QTL.

The term "isoline" is a comparative term, and references organisms that are genetically identical, but differ in treatment. In one example, two genetically identical maize plant embryos may be separated into two different groups, one receiving a treatment (such as the introduction of a CRISPR-Cas effector endonuclease) and one control that does not receive such treatment. Any phenotypic differences between the two groups may thus be attributed solely to the treatment and not to any inherency of the plant's endogenous genetic makeup.

"Introducing" is intended to mean presenting to a target, such as a cell or organism, a polynucleotide or polypeptide or polynucleotide-protein complex, in such a manner that the component(s) gains access to the interior of a cell of the organism or to the cell itself.

A "polynucleotide of interest" includes any nucleotide sequence encoding a protein or polypeptide that improves desirability of crops. Polynucleotides of interest: include, but are not limited to, polynucleotides encoding important traits for agronomics, herbicide-resistance, insecticidal resistance, disease resistance, nematode resistance, herbicide resistance, microbial resistance, fungal resistance, viral resistance, fertility or sterility, grain characteristics, commercial products, phenotypic marker, or any other trait of agronomic or commercial importance. A polynucleotide of interest may additionally be utilized in either the sense or anti-sense orientation. Further, more than one polynucleotide of interest may be utilized together, or "stacked", to provide additional benefit.

A "complex trait locus" includes a genomic locus that has multiple transgenes genetically linked to each other.

The compositions and methods herein may provide for an improved "agronomic trait" or "trait of agronomic importance" or "trait of agronomic interest" to a plant, which may include, but not be limited to, the following: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition, as compared to an isoline plant not comprising a modification derived from the methods or compositions herein.

"Agronomic trait potential" is intended to mean a capability of a plant element for exhibiting a phenotype, preferably an improved agronomic trait, at some point during its life cycle, or conveying said phenotype to another plant element with which it is associated in the same plant.

The terms "decreased," "fewer," "slower" and "increased" "faster" "enhanced" "greater" as used herein refers to a decrease or increase in a characteristic of the modified plant element or resulting plant compared to an unmodified plant element or resulting plant. For example, a decrease in a characteristic may be at least 1%, at least 2%, at least 3%, at least 4%, at least 5%, between 5% and 10%, at least 10%, between 10% and 20%, at least 15%, at least 20%, between 20% and 30%, at least 25%, at least 30%, between 30% and 40%, at least 35%, at least 40%, between 40% and 50%, at least 45%, at least 50%, between 50% and 60%, at least 60%, between 60% and 70%, between 70% and 80%, at least 75%, at least 80%, between 80% and 90%, at least 90%, between 90% and 100%, at least 100%, between 100% and 200%, at least 200%, at least 300%, at least 400%) or more lower than the untreated control and an increase may be at least 1%, at least 2%, at least 3%, at least 4%, at least 5%, between 5% and 10%, at least 10%, between 10% and 20%, at least 15%, at least 20%, between 20% and 30%, at least 25%, at least 30%, between 30% and 40%, at least 35%, at least 40%, between 40% and 50%, at least 45%, at least 50%, between 50% and 60%, at least 60%, between 60% and 70%, between 70% and 80%, at least 75%, at least 80%, between 80% and 90%, at least 90%, between 90% and 100%, at least 100%, between 100% and 200%, at least 200%, at least 300%), at least 400% or more higher than the untreated control.

As used herein, the term "before", in reference to a sequence position, refers to an occurrence of one sequence upstream, or 5', to another sequence.

The meaning of abbreviations is as follows: "sec" means second(s), "min" means minute(s), "h" means hour(s), "d" means day(s), "uL" means microliter(s), "mL" means milliliter(s), "L" means liter(s), "uM" means micromolar, "mM" means millimolar, "M" means molar, "mmol" means millimole(s), "umole" or "umole" mean micromole(s), "g" means gram(s), "ug" or "ug" means microgram(s), "ng" means nanogram(s), "U" means unit(s), "bp" means base pair(s) and "kb" means kilobase(s).

Classification of CRISPR-Cas Systems

CRISPR-Cas systems have been classified according to sequence and structural analysis of components. Multiple CRISPR/Cas systems have been described including Class 1 systems, with multisubunit effector complexes (comprising type I, type III, and type IV), and Class 2 systems, with single protein effectors (comprising type II, type V, and type VI) (Makarova et al. 2015, *Nature Reviews Microbiology* Vol. 13:1-15; Zetsche et al., 2015, *Cell* 163, 1-13; Shmakov et al., 2015, *Molecular Cell* 60, 1-13; Haft et al., 2005, *Computational Biology, PLoS Comput Biol* 1(6): e60; and Koonin et al. 2017, *Curr Opinion Microbiology* 37:67-78).

A CRISPR-Cas system comprises, at a minimum, a CRISPR RNA (crRNA) molecule and at least one CRISPR-associated (Cas) protein to form crRNA ribonucleoprotein (crRNP) effector complexes. CRISPR-Cas loci comprise an array of identical repeats interspersed with DNA-targeting spacers that encode the crRNA components and an operon-like unit of cas genes encoding the Cas protein components. The resulting ribonucleoprotein complex is called a Cascade, that recognizes a polynucleotide in a sequence-specific manner (Jore et al., *Nature Structural & Molecular Biology* 18, 529-536 (2011)). The crRNA serves as a guide RNA for sequence specific binding of the effector (protein or complex) to double strand DNA sequences, by forming base pairs with the complementary DNA strand while displacing the noncomplementary strand to form a so-called R-loop. (Jore et al., 2011. *Nature Structural & Molecular Biology* 18, 529-536).

The Cas endonuclease is guided by a single CRISPR RNA (crRNA) through direct RNA-DNA base-pairing to recognize a DNA target site that is in close vicinity to a protospacer adjacent motif (PAM) (Jore, M. M. et al., 2011, *Nat. Struct. Mol. Biol.* 18:529-536, Westra, E. R. et al., 2012, *Molecular Cell* 46:595-605, and Sinkunas, T. et al., 2013, *EMBO J.* 32:385-394). Class 1 CRISPR-Cas systems comprise Types I, III, and IV. A characteristic feature of Class I systems is the presence of an effector endonuclease complex instead of a single protein. Class 2 CRISPR-Cas systems comprise Types II, V, and VI. A characteristic feature of Class 2 systems is the presence of a single Cas protein instead of an effector module endonuclease complex. Types II and V Cas proteins comprise an RuvC-like endonuclease domain that adopts the RNase H fold.

Class 2 Type II CRISPR/Cas systems employ a crRNA and tracrRNA (trans-activating CRISPR RNA) to guide the Cas endonuclease to its DNA target. The crRNA comprises a spacer region complementary to one strand of the double strand DNA target and a region that base pairs with the tracrRNA (trans-activating CRISPR RNA) forming a RNA duplex that directs the Cas endonuclease to cleave the DNA target. For the *S. pyogenes* Cas9 endonuclease, the cleavage leaves a blunt end. Type II CRISR-Cas loci can encode a tracrRNA, which is partially complementary to the repeats within the respective CRISPR array, and can comprise other proteins.

Cas Endonuclease CRISPR-Cas System Components
Cas Endonucleases and Effectors

Endonucleases are enzymes that cleave the phosphodiester bond within a polynucleotide chain. Examples of endonucleases include restriction endonucleases, meganucleases, TAL effector nucleases (TALENs), zinc finger nucleases, and Cas (CRISPR-associated) effector endonucleases.

Cas endonucleases, either as single effector proteins or in an effector complex with other components, unwind the DNA duplex at the target sequence and optionally cleave at least one DNA strand, as mediated by recognition of the target sequence by a polynucleotide (such as, but not limited to, a crRNA or guide RNA) that is in complex with the Cas endonuclease. Such recognition and cutting of a target sequence by a Cas endonuclease typically occurs if the correct protospacer-adjacent motif (PAM) is located at or adjacent to the 3' end of the DNA target sequence. Alternatively, a Cas endonuclease herein may lack DNA cleavage or nicking activity, but can still specifically bind to a DNA target sequence when complexed with a suitable RNA component. (See also U.S. Patent Application US20150082478 published 19 Mar. 2015 and US20150059010 published 26 Feb. 2015).

Cas endonucleases that have been described include, but are not limited to, for example: Cas3 (a feature of Class 1 type I systems), Cas9 (a feature of Class 2 type II systems) and Cas12 (Cpf1) (a feature of Class 2 type V systems).

Cas9 (formerly referred to as Cas5, Csn1, or Csx12) is a Cas endonuclease that forms a complex with a crNucleotide and a tracrNucleotide, or with a single guide polynucleotide, for specifically recognizing and cleaving all or part of a DNA target sequence. The canonical Cas9 recognizes a 3' GC-rich PAM sequence on the target dsDNA, typically comprising an NGG motif. The Cas9 orthologs described herein may recognize additional PAM sequences and used to modify target sites with different recognition sequence specificity.

A Cas9 protein comprises a RuvC nuclease with an HNH (H-N-H) nuclease adjacent to the RuvC-II domain. The RuvC nuclease and HNH nuclease each can cleave a single DNA strand at a target sequence (the concerted action of both domains leads to DNA double-strand cleavage, whereas activity of one domain leads to a nick). In general, the RuvC domain comprises subdomains I, II and III, where domain I is located near the N-terminus of Cas9 and subdomains II and III are located in the middle of the protein, flanking the HNH domain (Hsu et al., 2013, *Cell* 157:1262-1278). Cas9 endonucleases are typically derived from a type II CRISPR system, which includes a DNA cleavage system utilizing a Cas9 endonuclease in complex with at least one polynucleotide component. For example, a Cas9 can be in complex with a CRISPR RNA (crRNA) and a trans-activating CRISPR RNA (tracrRNA). In another example, a Cas9 can be in complex with a single guide RNA (Makarova et al. 2015, *Nature* Reviews Microbiology Vol. 13:1-15).

Cas endonucleases and effector proteins can be used for targeted genome editing (via simplex and multiplex double-strand breaks and nicks) and targeted genome regulation (via tethering of epigenetic effector domains to either the Cas protein or sgRNA. A Cas endonuclease can also be engineered to function as an RNA-guided recombinase, and via RNA tethers could serve as a scaffold for the assembly of multiprotein and nucleic acid complexes (Mali et al., 2013, *Nature Methods Vol.* 10: 957-963).

The Cas9 orthologs described herein further comprise endonuclease activity.

A Cas9 ortholog protein is further defined as a functional fragment or functional variant of a native Cas9 ortholog protein, or a protein that shares at least 50%, between 50% and 55%, at least 55%, between 55% and 60%, at least 60%, between 60% and 65%, at least 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, between 500 and 550, at least 550, between 550 and 600, at least 600, between 600 and 650, at least 650, between 650 and 700, at least 700, between 700 and 750, at least 750, between 750 and 800, at least 800, between 800 and 850, at least 850, between 850 and 900, at least 900, between 900 and 950, at least 950, between 950 and 1000, at least 1000, or even than 1000 contiguous amino acids of any of SEQ ID NO:86-170 and 511-1135, and retains at least partial activity of the native, full-length Cas9 ortholog protein of any of SEQ ID NO:86-170 and 511-1135.

In some aspects, a Cas9 ortholog may comprises a polypeptide selected from the group consisting of: a polypeptide sharing at least 80%, between 80% and 85%, at least 85%, between 85% and 90%, at least 90%, between 90% and 95%, at least 95%, at least 96%, at least 97%, at least 98%, at least 99%, at least 99.5%, or greater than 99.5% identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, between 500 and 550, at least 550, between 550 and 600, at least 600, between 600 and 650, at least 650, between 650 and 700, at least 700, between 700 and 750, at least 750, between 750 and 800, at least 800, between 800 and 850, at least 850, between 850 and 900, at least 900, between 900 and 950, at least 950, between 950 and 1000, at least 1000, or even than 1000 contiguous amino acids of any of any of: SEQ ID NO:86-171 and 511-1135; a functional variant of any of SEQ ID NO:86-171 and 511-1135; a functional fragment of any of SEQ ID NO:86-171 and 511-1135; a Cas endonuclease encoded by a polynucleotide selected from the group consisting of: SEQ ID NO: 1-85; a Cas endonuclease that recognizes a PAM sequence listed in any of Tables 4-83; a Cas endonuclease that recognizes a PAM sequence selected from the group consisting of: NAR (G>A)WH (A>T>C)GN (C>T>R), N (C>D)V (A>S)R (G>A)TTTN (T>V), NV (A>G>C)TTTTT, NATTTTT, NN (H>G)AAAN (G>A>Y)N, N (T>V)NAAATN, NAV (A>G>C)TCNN, NN (A>S>T)NN (W>G>C)CCN (Y>R), NNAH (T>M)ACN, NGTGANN, NARN (A>K>C)ATN, NV (G>A>C)RNTTN, NN (A>B)RN (A>G>T>C)CCN, NN (A>B)NN (T>V)CCH (A>Y), NNN (H>G)NCDAA, NN (H>G)D (A>K)GGDN (A>B), NNNNCCAG, NNNNCTAA, NNNNCVGANN (SEQ ID NO:1746), N (C>D)NNTCCN, NNNNCTA, NNNNCYAA, NAGRGNY, NNGH (W>C)AAA, NNGAAAN, NNAAAAA, NTGAR (G>A)N(A>Y>G)N (Y>R), N (C>D)H (C>W)GH (Y>A)N(A>B)AN(A>T>S), NNAAACN, NNGTAM (A>C)Y, NH (A>Y)ARNN (C>W>G)N, B (C>K)GGN(A>Y>G)N NN, N (T>C>R) AGAN (A>K>C)NN, NGGN (A>T>G>C)NNN, NGGD (A>T>G)TNN, NGGAN(T>A>C>G)NN, CGGWN (T>R>C)NN, NGGWGNN, N (B>A)GGNN (T>V)NN, NNGD (A>T>G)AY (T>C)N, N (T>V)H(T>C>A)AAAAN, NRTAANN, N (H>G)CAAH (Y>A)N(Y>R)N, NATAAN (A>T>S)N, NV (A>G>C)R (A>G)ACCN, CN (C>W>G) AV (A>S)GAC, NNRNCAC, N(A>B)GGD (W>G)D (G>W)NN, BGD (G>W)GTCN(A>K>C), NAANACN, NRTHAN(A>B)N, BHN (H>G)NGN(T>M)H(Y>A), NMRN(A>Y>G)AH(C>T>A)N, NNNCACN, NARN (T>A>S)ACN, NNNNATW, NGCNGCN, NNNCATN, NAGNGCN, NARN(T>M>G)CCN, NATCCTN, NRTAAN (T>A>S)N, N(C>T>G>A)AAD (A>G>T)CNN, NAAAGNN, NNGACNN, N(T>V)NTAAD (A>T>G)N, NNGAD (G>W)NN, NGGN(W>S)NNN, N(T>V)GGD (W>G)GNN, NGGD(A>T>G)N(T>M>G)NN, NNAAAGN, N(G>H)GGDN(T>M>G)NN, NNAGAAA, NN(T>M>G)AAAAA, N(C>D)N(C>W>G)GW(T>C)D (A>G>T)AA, NAAAAYN, NRGNNNN, NATGN (H>G) TN, NNDATTT, and NATARCN(C>T>A>G); a Cas endonuclease that is capable of recognizing a PAM sequence that is one, two, three, four, five, six, seven, eight, nine, or ten nucleotides in length; a Cas endonuclease that comprises a domain at least 80%, between 80% and 85%, at least 85%, between 85% and 90%, at least 90%, between 90% and 95%, at least 95%, at least 96%, at least 97%, at least 98%, at least 99%, at least 99.5%, or greater than 99.5% identity with any of: SEQ ID NOs:1136-1730; a Cas endonuclease that has an activity score, according to the identical or similar method of Example 9 or summations of position scores of the amino acid table of Table 86A, of at least 1.0, between 1.0 and 2.0, at least 2.0, between 2.0 and 3.0, at least 3.0, between 3.0 and 4.0, at least 4.0, between 4.0 and 5.0, at least 5.0, between 5.0 and 6.0, at least 6.0, between 6.0 and 7.0, at least 7.0, between 7.0 and 8.0, at least 8.0, between 8.0 and 9.0, at least 9.0, between 9.0 and 10.0, at least 10.0, or even greater than 10.0; a Cas endonuclease comprising one, two, three, four, five, six, seven, eight, nine, ten, eleven, twelve, thirteen, fourteen, fifteen, sixteen, seventeen, eighteen, nineteen, twenty, twenty-one, twenty-two, twenty-three, twenty-four, twenty-five, or twenty-six of the signature amino acids identified in Table 86B, as compared to an alignment with the relative sequence position numbers of SEQ ID NO:1125; and a Cas endonuclease that is capable of forming a complex with a guide polynucleotide comprising any one of SEQ ID NOs: 426-510, 341-425, 141-255, or 256-340. In some aspects, the Cas9 polynucleotide has a plurality of the previously listed features.

The Cas9 ortholog or cas9 ortholog disclosed herein may further comprise a heterologous component. In some aspects, said heterologous component is selected from the group consisting of: a heterologous polynucleotide, a heterologous polypeptide, a particle, a solid matrix, and a Histidine tag. In some aspects, said heterologous polynucleotide is a guide polynucleotide, or a polynucleotide encoding a marker or purification tag, or a heterologous noncoding regulatory element to which it is operably linked.

In some aspects, the polynucleotide encoding the Cas9 endonuclease ortholog is comprised within a recombinant vector, that may further comprise additional components, such as but not limited to a heterologous promoter or other non-coding regulatory element.

A Cas9 ortholog endonuclease, effector protein, or functional fragment thereof, for use in the disclosed methods, can be isolated from a native source, or from a recombinant source where the genetically modified host cell is modified to express the nucleic acid sequence encoding the protein. Alternatively, the Cas9 ortholog protein can be produced using cell free protein expression systems, or be synthetically produced. Cas endonucleases may be isolated and introduced into a heterologous cell, or may be modified from its native form to exhibit a different type or magnitude of activity than what it would exhibit in its native source. Such modifications include but are not limited to: fragments, variants, substitutions, deletions, and insertions.

Fragments and variants of Cas9 orthologs can be obtained via methods such as site-directed mutagenesis and synthetic construction. Methods for measuring endonuclease activity are well known in the art such as, but not limiting to, WO2013166113 published 7 Nov. 2013, WO2016186953 published 24 Nov. 2016, and WO2016186946 published 24 Nov. 2016.

The Cas9 ortholog can comprise a modified form of the Cas polypeptide. The modified form of the Cas polypeptide can include an amino acid change (e.g., deletion, insertion, or substitution) that reduces the naturally-occurring nuclease activity of the Cas protein. For example, in some instances, the modified form of the Cas protein has less than 50%, less than 40%, less than 30%, less than 20%, less than 10%, less than 5%, or less than 1% of the nuclease activity of the corresponding wild-type Cas polypeptide (US20140068797 published 6 Mar. 2014). In some cases, the modified form of the Cas polypeptide has no substantial nuclease activity and is referred to as catalytically "inactivated Cas" or "deactivated Cas (dCas)." An inactivated Cas/deactivated Cas includes a deactivated Cas endonuclease (dCas). A catalytically inactive Cas endonuclease can be fused to a heterologous sequence to induce or modify activity.

A Cas9 ortholog can be part of a fusion protein comprising one or more heterologous protein domains (e.g., 1, 2, 3, or more domains in addition to the Cas protein). Such a fusion protein may comprise any additional protein sequence, and optionally a linker sequence between any two domains, such as between Cas and a first heterologous domain. Examples of protein domains that may be fused to a Cas protein herein include, without limitation, epitope tags (e.g., histidine [His], V5, FLAG, influenza hemagglutinin [HA], myc, VSV-G, thioredoxin [Trx]), reporters (e.g., glutathione-5-transferase [GST], horseradish peroxidase [HRP], chloramphenicol acetyltransferase [CAT], beta-galactosidase, beta-glucuronidase [GUS], luciferase, green fluorescent protein [GFP], HcRed, DsRed, cyan fluorescent protein [CFP], yellow fluorescent protein [YFP], blue fluorescent protein [BFP]), and domains having one or more of the following activities: methylase activity, demethylase activity, transcription activation activity (e.g., VP16 or VP64), transcription repression activity, transcription release factor activity, histone modification activity, RNA cleavage activity and nucleic acid binding activity. A Cas9 ortholog can also be in fusion with a protein that binds DNA molecules or other molecules, such as maltose binding protein (MBP), S-tag, Lex A DNA binding domain (DBD), GAL4A DNA binding domain, and herpes simplex virus (HSV) VP16.

A catalytically active and/or inactive Cas9 ortholog can be fused to a heterologous sequence (US20140068797 published 6 Mar. 2014). Suitable fusion partners include, but are not limited to, a polypeptide that provides an activity that indirectly increases transcription by acting directly on the target DNA or on a polypeptide (e.g., a histone or other DNA-binding protein) associated with the target DNA. Additional suitable fusion partners include, but are not limited to, a polypeptide that provides for methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, or demyristoylation activity. Further suitable fusion partners include, but are not limited to, a polypeptide that directly provides for increased transcription of the target nucleic acid (e.g., a transcription activator or a fragment thereof, a protein or fragment thereof that recruits a transcription activator, a small molecule/drug-responsive transcription regulator, etc.). A catalytically inactive Cas can also be fused to a FokI nuclease to generate double-strand breaks (Guilinger et al. *Nature Biotechnology*, volume 32, number 6, June 2014). In some aspects, the Cas9 ortholog is a fusion protein further comprising a nuclease domain, a transcriptional activator domain, a transcriptional repressor domain, an epigenetic modification domain, a cleavage domain, a nuclear localization signal, a cell-penetrating domain, a translocation domain, a marker, or a transgene that is heterologous to the target polynucleotide sequence or to the cell from which said target polynucleotide sequence is obtained or derived. In some aspects, the nuclease fusion protein comprises Clo51 or Fok1.

The Cas9 orthologs described herein can be expressed and purified by methods known in the art, for example as described in WO/2016/186953 published 24 Nov. 2016.

A Cas endonuclease can comprise a heterologous nuclear localization sequence (NLS). A heterologous NLS amino acid sequence herein may be of sufficient strength to drive accumulation of a Cas protein in a detectable amount in the nucleus of a yeast cell herein, for example. An NLS may comprise one (monopartite) or more (e.g., bipartite) short sequences (e.g., 2 to 20 residues) of basic, positively charged residues (e.g., lysine and/or arginine), and can be located anywhere in a Cas amino acid sequence but such that it is exposed on the protein surface. An NLS may be operably linked to the N-terminus or C-terminus of a Cas protein herein, for example. Two or more NLS sequences can be linked to a Cas protein, for example, such as on both the N- and C-termini of a Cas protein. The Cas endonuclease gene can be operably linked to a SV40 nuclear targeting signal upstream of the Cas codon region and a bipartite VirD2 nuclear localization signal (Tinland et al. (1992) *Proc. Natl. Acad. Sci. USA* 89:7442-6) downstream of the Cas codon region. Non-limiting examples of suitable NLS sequences herein include those disclosed in U.S. Pat. Nos. 6,660,830 and 7,309,576.

An artificial (non-naturally occurring) Cas endonuclease may be produced from a native, or parental, Cas endonuclease molecule, by any means known in the art. In some aspects, this is achieved through mutagenesis of the gene encoding the endonuclease protein. In some aspects, mutagenesis is achieved via a method selected from the group consisting of: the use of a double-strand break inducing agent acting on the endonuclease gene; radiation mutagenesis; chemical mutagenesis; the addition, deletion, substitution, insertion, or alteration of at least one polynucleotide in the gene encoding the endonuclease; or the substitution of one or more codons for an amino acid. In some aspects, directed evolution of the endonuclease molecule may be employed to optimize the expression or activity of the Cas endonuclease, and may be achieved via stochastic or non-stochastic protein shuffling methods which are known in the art.

Protospacer Adjacent Motif (PAM)

A "protospacer adjacent motif" (PAM) herein refers to a short nucleotide sequence adjacent to a target sequence (protospacer) that can be recognized (targeted) by a guide polynucleotide/Cas endonuclease system. In some aspects, the Cas endonuclease may not successfully recognize a target DNA sequence if the target DNA sequence is not adjacent to, or near, a PAM sequence. In some aspects, the PAM precedes the target sequence (e.g. Cas12a). In some aspects, the PAM follows the target sequence (e.g. *S. pyogenes* Cas9). The sequence and length of a PAM herein can differ depending on the Cas protein or Cas protein complex used. The PAM sequence can be of any length but is typically 1, 2, 3, 4, 5, 6, 7, 8, 9, 10, 11, 12, 13, 14, 15, 16, 17, 18, 19 or 20 nucleotides long.

A "randomized PAM" and "randomized protospacer adjacent motif" are used interchangeably herein, and refer to a random DNA sequence adjacent to a target sequence (protospacer) that is recognized (targeted) by a guide polynucleotide/Cas endonuclease system. The randomized PAM sequence can be of any length but is typically 1, 2, 3, 4, 5, 6, 7, 8, 9, 10, 11, 12, 13, 14, 15, 16, 17, 18, 19 or 20 nucleotides long. A randomized nucleotide includes anyone of the nucleotides A, C, G or T.

Many Cas endonucleases have been described to date that can recognize specific PAM sequences (WO2016186953 published 24 Nov. 2016, WO2016186946 published 24 Nov. 2016, and Zetsche B et al. 2015. Cell 163, 1013) and cleave the target DNA at a specific position. It is understood that based on the methods and embodiments described herein utilizing a novel guided Cas system one skilled in the art can now tailor these methods such that they can utilize any guided endonuclease system.

PAM sequences that correspond to some of the Cas9 orthologs of the instant invention are described in Tables 4-50.

Guide Polynucleotides

The guide polynucleotide enables target recognition, binding, and optionally cleavage by the Cas endonuclease, and can be a single molecule or a double molecule. The guide polynucleotide sequence can be a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises ribonucleic acids is also referred to as a "guide RNA" or "gRNA" (US20150082478 published 19 Mar. 2015 and US20150059010 published 26 Feb. 2015). A guide polynucleotide may be engineered or synthetic.

The guide polynucleotide includes a chimeric non-naturally occurring guide RNA comprising regions that are not found together in nature (i.e., they are heterologous with respect to each other). For example, a chimeric non-naturally occurring guide RNA comprising a first nucleotide sequence domain (referred to as Variable Targeting domain or VT domain) that can hybridize to a nucleotide sequence in a target DNA, linked to a second nucleotide sequence that can recognize the Cas endonuclease, such that the first and second nucleotide sequence are not found linked together in nature.

The guide polynucleotide can be a double molecule (also referred to as duplex guide polynucleotide) comprising a crNucleotide sequence and a tracrNucleotide sequence. The crNucleotide includes a first nucleotide sequence domain (referred to as Variable Targeting domain or VT domain) that can hybridize to a nucleotide sequence in a target DNA and a second nucleotide sequence (also referred to as a tracr mate sequence) that is part of a Cas endonuclease recognition (CER) domain. The tracr mate sequence can hybridized to a tracrNucleotide along a region of complementarity and together form the Cas endonuclease recognition domain or CER domain. The CER domain is capable of interacting with a Cas endonuclease polypeptide. The crNucleotide and the tracrNucleotide of the duplex guide polynucleotide can be RNA, DNA, and/or RNA-DNA-combination sequences.

In some embodiments, the crNucleotide molecule of the duplex guide polynucleotide is referred to as "crDNA" (when composed of a contiguous stretch of DNA nucleotides) or "crRNA" (when composed of a contiguous stretch of RNA nucleotides), or "crDNA-RNA" (when composed of a combination of DNA and RNA nucleotides). The crNucleotide can comprise a fragment of the crRNA naturally occurring in Bacteria and Archaea. The size of the fragment of the crRNA naturally occurring in Bacteria and Archaea that can be present in a crNucleotide disclosed herein can range from, but is not limited to, 2, 3, 4, 5, 6, 7, 8, 9, 10, 11, 12, 13, 14, 15, 16, 17, 18, 19, 20 or more nucleotides.

The tracrRNA (trans-activating CRISPR RNA) comprises, in the 5'-to-3' direction, (i) an "anti-repeat" sequence that anneals with the repeat region of CRISPR type II crRNA and (ii) a stem loop-comprising portion (Deltcheva et al., Nature 471:602-607). The duplex guide polynucleotide can form a complex with a Cas endonuclease, wherein said guide polynucleotide/Cas endonuclease complex (also referred to as a guide polynucleotide/Cas endonuclease system) can direct the Cas endonuclease to a genomic target site, enabling the Cas endonuclease to recognize, bind to, and optionally nick or cleave (introduce a single or double-strand break) into the target site. (US20150082478 published 19 Mar. 2015 and US20150059010 published 26 Feb. 2015). In some embodiments, the tracrNucleotide is referred to as "tracrRNA" (when composed of a contiguous stretch of RNA nucleotides) or "tracrDNA" (when composed of a contiguous stretch of DNA nucleotides) or "tracrDNA-RNA" (when composed of a combination of DNA and RNA nucleotides.

In one embodiment, the RNA that guides the RNA/Cas endonuclease complex is a duplexed RNA comprising a duplex crRNA-tracrRNA.

In one aspect, the guide polynucleotide is a guide polynucleotide capable of forming a PGEN as described herein, wherein said guide polynucleotide comprises a first nucleotide sequence domain that is complementary to a nucleotide sequence in a target DNA, and a second nucleotide sequence domain that interacts with said Cas endonuclease polypeptide.

In one aspect, the guide polynucleotide is a guide polynucleotide described herein, wherein the first nucleotide sequence and the second nucleotide sequence domain is selected from the group consisting of a DNA sequence, a RNA sequence, and a combination thereof.

In one aspect, the guide polynucleotide is a guide polynucleotide described herein, wherein the first nucleotide sequence and the second nucleotide sequence domain is selected from the group consisting of RNA backbone modifications that enhance stability, DNA backbone modifications that enhance stability, and a combination thereof (see Kanasty et al., 2013, Common RNA-backbone modifications, Nature Materials 12:976-977; US20150082478 published 19 Mar. 2015 and US20150059010 published 26 Feb. 2015)

The guide RNA includes a dual molecule comprising a chimeric non-naturally occurring crRNA linked to at least one tracrRNA. A chimeric non-naturally occurring crRNA includes a crRNA that comprises regions that are not found together in nature (i.e., they are heterologous with each other. For example, a crRNA comprising a first nucleotide sequence domain (referred to as Variable Targeting domain or VT domain) that can hybridize to a nucleotide sequence in a target DNA, linked to a second nucleotide sequence (also referred to as a tracr mate sequence) such that the first and second sequence are not found linked together in nature.

The guide polynucleotide can also be a single molecule (also referred to as single guide polynucleotide) comprising a crNucleotide sequence linked to a tracrNucleotide sequence. The single guide polynucleotide comprises a first nucleotide sequence domain (referred to as Variable Targeting domain or VT domain) that can hybridize to a nucleotide sequence in a target DNA and a Cas endonuclease recognition domain (CER domain), that interacts with a Cas endonuclease polypeptide.

The term "variable targeting domain" or "VT domain" is used interchangeably herein and includes a nucleotide sequence that can hybridize (is complementary) to one strand (nucleotide sequence) of a double strand DNA target site. The % complementation between the first nucleotide sequence domain (VT domain) and the target sequence can be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable targeting domain can be at least 12, 13, 14, 15, 16, 17, 18, 19, 20, 21, 22, 23, 24, 25, 26, 27, 28, 29 or 30 nucleotides in length.

The VT domain and/or the CER domain of a single guide polynucleotide can comprise a RNA sequence, a DNA sequence, or a RNA-DNA-combination sequence. The single guide polynucleotide being comprised of sequences from the crNucleotide and the tracrNucleotide may be referred to as "single guide RNA" (when composed of a contiguous stretch of RNA nucleotides) or "single guide DNA" (when composed of a contiguous stretch of DNA nucleotides) or "single guide RNA-DNA" (when composed of a combination of RNA and DNA nucleotides). The single guide polynucleotide can form a complex with a Cas endonuclease, wherein said guide polynucleotide/Cas endonuclease complex (also referred to as a guide polynucleotide/Cas endonuclease system) can direct the Cas endonuclease to a genomic target site, enabling the Cas endonuclease to recognize, bind to, and optionally nick or cleave (introduce a single or double-strand break) the target site. (US20150082478 published 19 Mar. 2015 and US20150059010 published 26 Feb. 2015).

A chimeric non-naturally occurring single guide RNA (sgRNA) includes a sgRNA that comprises regions that are not found together in nature (i.e., they are heterologous with each other. For example, a sgRNA comprising a first nucleotide sequence domain (referred to as Variable Targeting domain or VT domain) that can hybridize to a nucleotide sequence in a target DNA linked to a second nucleotide sequence (also referred to as a tracr mate sequence) that are not found linked together in nature.

The nucleotide sequence linking the crNucleotide and the tracrNucleotide of a single guide polynucleotide can comprise a RNA sequence, a DNA sequence, or a RNA-DNA combination sequence. In one embodiment, the nucleotide sequence linking the crNucleotide and the tracrNucleotide of a single guide polynucleotide (also referred to as "loop") can be at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 78, 79, 80, 81, 82, 83, 84, 85, 86, 87, 88, 89, 90, 91, 92, 93, 94, 95, 96, 97, 98, 99 or 100 nucleotides in length. In another embodiment, the nucleotide sequence linking the crNucleotide and the tracrNucleotide of a single guide polynucleotide can comprise a tetraloop sequence, such as, but not limiting to a GAAA tetraloop sequence.

The guide polynucleotide can be produced by any method known in the art, including chemically synthesizing guide polynucleotides (such as but not limiting to Hendel et al. 2015, *Nature Biotechnology* 33, 985-989), in vitro generated guide polynucleotides, and/or self-splicing guide RNAs (such as but not limited to Xie et al. 2015, *PNAS* 112:3570-3575).

A method of expressing RNA components such as gRNA in eukaryotic cells for performing Cas9-mediated DNA targeting has been to use RNA polymerase III (Pol III) promoters, which allow for transcription of RNA with precisely defined, unmodified, 5'- and 3'-ends (DiCarlo et al., Nucleic Acids Res. 41: 4336-4343; Ma et al., Mol. Ther. Nucleic Acids 3:e161). This strategy has been successfully applied in cells of several different species including maize and soybean (US 20150082478, published on Mar. 19, 2015). Methods for expressing RNA components that do not have a 5' cap have been described (WO 2016/025131, published on Feb. 18, 2016).

A single guide RNA (sgRNA) molecule may comprise a VT domain.

A single guide RNA (sgRNA) molecule may comprise a crRNA repeat. In some aspects, the crRNA repeat is selected from the group consisting of: SEQ ID NO:171-255.

A single guide RNA (sgRNA) molecule may comprise a loop.

A single guide RNA (sgRNA) molecule may comprise an anti-repeat. In some aspects, the anti-repeat is selected from the group consisting of: SEQ ID NO:256-340.

A single guide RNA (sgRNA) molecule may comprise A 3' tracrRNA. In some aspects, the 3' tracrRNA is selected from the group consisting of: SEQ ID NO:341-425.

The terms "single guide RNA" and "sgRNA" are used interchangeably herein and relate to a synthetic fusion of two RNA molecules, a crRNA (CRISPR RNA) comprising a variable targeting domain (linked to a tracr mate sequence that hybridizes to a tracrRNA), fused to a tracrRNA (transactivating CRISPR RNA). The single guide RNA can comprise a crRNA or crRNA fragment and a tracrRNA or tracrRNA fragment of the type II CRISPR/Cas9 system that can form a complex with a type II Cas9 endonuclease, wherein said guide RNA/Cas9 endonuclease complex can direct the Cas9 endonuclease to a DNA target site, enabling the Cas9 endonuclease to recognize, bind to, and optionally nick or cleave (introduce a single or double strand break) the DNA target site.

In some aspects, the sgRNA is selected from the group consisting of: SEQ ID NO: 426-510.

Single guide RNAs targeting a target site in the genome of an organism can be designed by changing the Variable Targeting Domain (VT) of any of the guide polynucleotides described herein, with any random nucleotide that can hybridize to any desired target sequence.

In some embodiments, a subject nucleic acid (e.g., a guide polynucleotide, a nucleic acid comprising a nucleotide sequence encoding a guide polynucleotide; a nucleic acid encoding Cas9 endonuclease of the present disclosure; a crRNA or a nucleotide encoding a crRNA, a tracrRNA or a nucleotide encoding a tracrRNA, a nucleotide encoding a VT domain, a nucleotide encoding a CER domain, etc.) comprises a modification or sequence that provides for an additional desirable feature (e.g., modified or regulated stability; subcellular targeting; tracking, e.g., a fluorescent label; a binding site for a protein or protein complex; etc.). Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

Functional variants of a guide polynucleotide of the present disclosure can comprise a modified guide polynucleotide wherein the modification comprises adding, removing, or otherwise altering loops and/or hairpins in the single guide RNA.

Functional variants of a guide polynucleotide of the present disclosure can comprise a modified guide polynucleotide wherein the modification comprises one or more modified nucleotides in the nucleotide sequence, wherein the one or more modified nucleotides comprises at least one non-naturally-occurring nucleotide, nucleotide mimetic (as described in US application US2014/0068797, published Mar. 6, 2014), or analog thereof, or wherein the one or more modified nucleotides are selected from the group consisting of 2'-O-methylanalogs, 2'-fluoro analogs 2-aminopurine, 5-bromo-uridine, pseudouridine, and 7-methylguanosine.

In one aspect, the functional variant of the guide RNA can form a guide RNA/Cas9 endonuclease complex that can recognize, bind to, and optionally nick or cleave a target sequence.

Guide Polynucleotide/Cas Endonuclease Complexes

A guide polynucleotide/Cas endonuclease complex described herein is capable of recognizing, binding to, and optionally nicking, unwinding, or cleaving all or part of a target sequence.

A guide polynucleotide/Cas endonuclease complex that can cleave both strands of a DNA target sequence typically comprises a Cas protein that has all of its endonuclease domains in a functional state (e.g., wild type endonuclease domains or variants thereof retaining some or all activity in each endonuclease domain). Thus, a wild type Cas protein (e.g., a Cas protein disclosed herein), or a variant thereof retaining some or all activity in each endonuclease domain of the Cas protein, is a suitable example of a Cas endonuclease that can cleave both strands of a DNA target sequence.

A guide polynucleotide/Cas endonuclease complex that can cleave one strand of a DNA target sequence can be characterized herein as having nickase activity (e.g., partial cleaving capability). A Cas nickase typically comprises one functional endonuclease domain that allows the Cas to cleave only one strand (i.e., make a nick) of a DNA target sequence. For example, a Cas nickase may comprise (i) a mutant, dysfunctional RuvC domain and (ii) a functional HNH domain (e.g., wild type HNH domain). As another example, a Cas nickase may comprise (i) a functional RuvC domain (e.g., wild type RuvC domain) and (ii) a mutant, dysfunctional HNH domain. Non-limiting examples of Cas nickases suitable for use herein are disclosed in US20140189896 published on 3 Jul. 2014. A pair of Cas nickases can be used to increase the specificity of DNA targeting. In general, this can be done by providing two Cas nickases that, by virtue of being associated with RNA components with different guide sequences, target and nick nearby DNA sequences on opposite strands in the region for desired targeting. Such nearby cleavage of each DNA strand creates a double-strand break (i.e., a DSB with single-stranded overhangs), which is then recognized as a substrate for non-homologous-end-joining, NHEJ (prone to imperfect repair leading to mutations) or homologous recombination, HR. Each nick in these embodiments can be at least 5, between 5 and 10, at least 10, between 10 and 15, at least 15, between 15 and 20, at least 20, between 20 and 30, at least 30, between 30 and 40, at least 40, between 40 and 50, at least 50, between 50 and 60, at least 60, between 60 and 70, at least 70, between 70 and 80, at least 80, between 80 and 90, at least 90, between 90 and 100, or 100 or greater (or any number between 5 and 100) bases apart from each other, for example. One or two Cas nickase proteins herein can be used in a Cas nickase pair. For example, a Cas nickase with a mutant RuvC domain, but functioning HNH domain (i.e., Cas HNH+/RuvC−), can be used (e.g., *Streptococcus pyogenes* Cas HNH+/RuvC−). Each Cas nickase (e.g., Cas HNH+/RuvC−) can be directed to specific DNA sites nearby each other (up to 100 base pairs apart) by using suitable RNA components herein with guide RNA sequences targeting each nickase to each specific DNA site.

A guide polynucleotide/Cas endonuclease complex in certain embodiments can bind to a DNA target site sequence, but does not cleave any strand at the target site sequence. Such a complex may comprise a Cas protein in which all of its nuclease domains are mutant, dysfunctional. For example, a Cas protein that can bind to a DNA target site sequence, but does not cleave any strand at the target site sequence, may comprise both a mutant, dysfunctional RuvC domain and a mutant, dysfunctional HNH domain. A Cas protein herein that binds, but does not cleave, a target DNA sequence can be used to modulate gene expression, for example, in which case the Cas protein could be fused with a transcription factor (or portion thereof) (e.g., a repressor or activator, such as any of those disclosed herein).

In one embodiment of the disclosure, the guide polynucleotide/Cas endonuclease complex is a guide polynucleotide/Cas endonuclease complex (PGEN) comprising at least one guide polynucleotide and at least one Cas endonuclease polypeptide. In some aspects, the Cas endonuclease polypeptide comprises at least one protein subunit of another Cas protein, or a functional fragment thereof, wherein said guide polynucleotide is a chimeric non-naturally occurring guide polynucleotide, wherein said guide polynucleotide/Cas endonuclease complex is capable of recognizing, binding to, and optionally nicking, unwinding, or cleaving all or part of a target sequence.

In some aspects, the PGEN is a ribonucleoprotein complex (RNP), wherein the Cas 9 ortholog is provided as a protein and the guide polynucleotide is provided as a ribonucleotide.

The Cas endonuclease protein can be a Cas9 ortholog as disclosed herein.

In one embodiment of the disclosure, the guide polynucleotide/Cas effector complex is a guide polynucleotide/Cas endonuclease complex (PGEN) comprising at least one guide polynucleotide and a Cas9 ortholog endonuclease, wherein said guide polynucleotide/Cas endonuclease complex is capable of recognizing, binding to, and optionally nicking, unwinding, or cleaving all or part of a target sequence.

The PGEN can be a guide polynucleotide/Cas endonuclease complex, wherein said Cas endonuclease further comprises one copy or multiple copies of at least one protein subunit, or a functional fragment thereof, of an additional Cas protein.

In one aspect, the guide polynucleotide/Cas endonuclease complex (PGEN) described herein is a PGEN, wherein said Cas endonuclease is covalently or non-covalently linked to at least one Cas protein subunit, or functional fragment thereof. The PGEN can be a guide polynucleotide/Cas endonuclease complex, wherein said Cas endonuclease polypeptide is covalently or non-covalently linked, or assembled to one copy or multiple copies of at least one protein subunit, or a functional fragment thereof, of a Cas protein selected from the group consisting of a Cas1 protein subunit, a Cas2 protein subunit, a Cas4 protein subunit, and any combination thereof, in some aspects effectively forming a cleavage ready Cascade. The PGEN can be a guide polynucleotide/Cas endonuclease complex, wherein said Cas endonuclease is covalently or non-covalently linked or assembled to at least two different protein subunits of a Cas protein selected from the group consisting of a Cas1, a Cas2, and Cas4. The PGEN can be a guide polynucleotide/Cas endonuclease complex, wherein said Cas endonuclease is covalently or non-covalently linked to at least three different protein subunits, or functional fragments thereof, of a Cas protein selected from the group consisting of a Cas1, a Cas2, and Cas4, and any combination thereof.

Any component of the guide polynucleotide/Cas endonuclease complex, the guide polynucleotide/Cas endonuclease complex itself, as well as the polynucleotide modification template(s) and/or donor DNA(s), can be introduced into a heterologous cell or organism by any method known in the art.

Some uses for guide RNA/Cas9 endonuclease systems include but are not limited to modifying or replacing nucleotide sequences of interest (such as a regulatory elements), insertion of polynucleotides of interest, gene knock-out, gene-knock in, modification of splicing sites and/or introducing alternate splicing sites, modifications of nucleotide sequences encoding a protein of interest, amino acid and/or protein fusions, and gene silencing by expressing an inverted repeat into a gene of interest.

Recombinant Constructs for Transformation of Cells

The disclosed guide polynucleotides, Cas endonucleases, polynucleotide modification templates, donor DNAs, guide polynucleotide/Cas endonuclease systems disclosed herein, and any one combination thereof, optionally further comprising one or more polynucleotide(s) of interest, can be introduced into a cell. Cells include, but are not limited to, human, non-human, animal, bacterial, fungal, insect, yeast, non-conventional yeast, and plant cells as well as plants and seeds produced by the methods described herein.

Standard recombinant DNA and molecular cloning techniques used herein are well known in the art and are described more fully in Sambrook et al., *Molecular Cloning: A Laboratory Manual; Cold Spring Harbor Laboratory*: Cold Spring Harbor, NY (1989). Transformation methods are well known to those skilled in the art and are described infra.

Vectors and constructs include circular plasmids, and linear polynucleotides, comprising a polynucleotide of interest and optionally other components including linkers, adapters, regulatory or analysis. In some examples a recognition site and/or target site can be comprised within an intron, coding sequence, 5' UTRs, 3' UTRs, and/or regulatory regions.

Components for Expression and Utilization of Novel CRISPR-Cas Systems in Prokaryotic and Eukaryotic Cells The invention further provides expression constructs for expressing in a prokaryotic or eukaryotic cell/organism a guide RNA/Cas system that is capable of recognizing, binding to, and optionally nicking, unwinding, or cleaving all or part of a target sequence.

In one embodiment, the expression constructs of the disclosure comprise a promoter operably linked to a nucleotide sequence encoding a Cas gene (or optimized sequence, including a Cas endonuclease gene described herein) and a promoter operably linked to a guide RNA of the present disclosure. The promoter is capable of driving expression of an operably linked nucleotide sequence in a prokaryotic or eukaryotic cell/organism.

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

A method of expressing RNA components such as gRNA in eukaryotic cells for performing Cas9-mediated DNA targeting has been to use RNA polymerase III (Pol III) promoters, which allow for transcription of RNA with precisely defined, unmodified, 5'- and 3'-ends (DiCarlo et al., *Nucleic Acids Res*. 41: 4336-4343; Ma et al., *Mol. Ther. Nucleic Acids* 3:e161). This strategy has been successfully applied in cells of several different species including maize and soybean (US20150082478 published 19 Mar. 2015). Methods for expressing RNA components that do not have a 5' cap have been described (WO2016/025131 published 18 Feb. 2016).

Various methods and compositions can be employed to obtain a cell or organism having a polynucleotide of interest inserted in a target site for a Cas endonuclease. Such methods can employ homologous recombination (HR) to provide integration of the polynucleotide of interest at the target site. In one method described herein, a polynucleotide of interest is introduced into the organism cell via a donor DNA construct.

The donor DNA construct further comprises a first and a second region of homology that flank the polynucleotide of interest. The first and second regions of homology of the donor DNA share homology to a first and a second genomic region, respectively, present in or flanking the target site of the cell or organism genome.

The donor DNA can be tethered to the guide polynucleotide. Tethered donor DNAs can allow for co-localizing target and donor DNA, useful in genome editing, gene insertion, and targeted genome regulation, and can also be useful in targeting post-mitotic cells where function of endogenous HR machinery is expected to be highly diminished (Mali et al., 2013, *Nature Methods* Vol. 10: 957-963).

The amount of homology or sequence identity shared by a target and a donor polynucleotide can vary and includes total lengths and/or regions having unit integral values in the ranges of about 1-20 bp, 20-50 bp, 50-100 bp, 75-150 bp, 100-250 bp, 150-300 bp, 200-400 bp, 250-500 bp, 300-600 bp, 350-750 bp, 400-800 bp, 450-900 bp, 500-1000 bp, 600-1250 bp, 700-1500 bp, 800-1750 bp, 900-2000 bp, 1-2.5 kb, 1.5-3 kb, 2-4 kb, 2.5-5 kb, 3-6 kb, 3.5-7 kb, 4-8 kb, 5-10 kb, or up to and including the total length of the target site. These ranges include every integer within the range, for example, the range of 1-20 bp includes 1, 2, 3, 4, 5, 6, 7, 8, 9, 10, 11, 12, 13, 14, 15, 16, 17, 18, 19 and 20 bps. The amount of homology can also be described by percent sequence identity over the full aligned length of the two polynucleotides which includes percent sequence identity of about at least 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, between 98% and 99%, 99%, between 99% and 100%, or 100%. Sufficient homology includes any combination of polynucleotide length, global percent sequence identity, and optionally conserved regions of contiguous nucleotides or local percent sequence identity, for example sufficient homology can be described as a region of 75-150 bp having at least 80% sequence identity to a region of the target locus. Sufficient homology can also be described by the predicted ability of two polynucleotides to specifically hybridize under high stringency conditions, see, for example, Sambrook et al., (1989) *Molecular Cloning: A Laboratory Manual*, (Cold Spring Harbor Laboratory Press, NY); *Current Protocols in Molecular Biology*, Ausubel et al., Eds (1994) *Current Protocols*, (Greene Publishing Associates, Inc. and John Wiley & Sons, Inc.); and, Tijssen (1993) *Laboratory Techniques in Biochemistry and Molecular Biology—Hybridization with Nucleic Acid Probes,* (Elsevier, New York).

The structural similarity between a given genomic region and the corresponding region of homology found on the donor DNA can be any degree of sequence identity that allows for homologous recombination to occur. For example, the amount of homology or sequence identity shared by the "region of homology" of the donor DNA and the "genomic region" of the organism genome can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination The region of homology on the donor DNA can have homology to any sequence flanking the target site. While in some instances the regions of homology share significant sequence homology to the genomic sequence immediately flanking the target site, it is recognized that the regions of homology can be designed to have sufficient homology to regions that may be further 5' or 3' to the target site. The regions of homology can also have homology with a fragment of the target site along with downstream genomic regions In one embodiment, the first region of homology further comprises a first fragment of the target site and the second region of homology comprises a second fragment of the target site, wherein the first and second fragments are dissimilar.

Polynucleotides of Interest

Polynucleotides of interest are further described herein and include polynucleotides reflective of the commercial markets and interests of those involved in the development of the crop. Crops and markets of interest change, and as developing nations open up world markets, new crops and technologies will emerge also. In addition, as our understanding of agronomic traits and characteristics such as yield and heterosis increase, the choice of genes for genetic engineering will change accordingly.

General categories of polynucleotides of interest include, for example, genes of interest involved in information, such as zinc fingers, those involved in communication, such as kinases, and those involved in housekeeping, such as heat shock proteins. More specific polynucleotides of interest include, but are not limited to, genes involved in crop yield, grain quality, crop nutrient content, starch and carbohydrate quality and quantity as well as those affecting kernel size, sucrose loading, protein quality and quantity, nitrogen fixation and/or utilization, fatty acid and oil composition, genes encoding proteins conferring resistance to abiotic stress (such as drought, nitrogen, temperature, salinity, toxic metals or trace elements, or those conferring resistance to toxins such as pesticides and herbicides), genes encoding proteins conferring resistance to biotic stress (such as attacks by fungi, viruses, bacteria, insects, and nematodes, and development of diseases associated with these organisms).

Agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389.

Polynucleotide sequences of interest may encode proteins involved in providing disease or pest resistance. By "disease resistance" or "pest resistance" is intended that the plants avoid the harmful symptoms that are the outcome of the plant-pathogen interactions. Pest resistance genes may encode resistance to pests that have great yield drag such as rootworm, cutworm, European Corn Borer, and the like. Disease resistance and insect resistance genes such as lysozymes or cecropins for antibacterial protection, or proteins such as defensins, glucanases or chitinases for antifungal protection, or *Bacillus thuringiensis* endotoxins, protease inhibitors, collagenases, lectins, or glycosidases for controlling nematodes or insects are all examples of useful gene products. Genes encoding disease resistance traits include detoxification genes, such as against fumonisin (U.S. Pat. No. 5,792,931); avirulence (avr) and disease resistance (R) genes (Jones et al. (1994) *Science* 266:789; Martin et al. (1993) *Science* 262:1432; and Mindrinos et al. (1994) *Cell* 78:1089); and the like. Insect resistance genes may encode resistance to pests that have great yield drag such as rootworm, cutworm, European Corn Borer, and the like. Such genes include, for example, *Bacillus thuringiensis* toxic protein genes (U.S. Pat. Nos. 5,366,892; 5,747,450; 5,736,514; 5,723,756; 5,593,881; and Geiser et al. (1986) *Gene* 48:109); and the like.

An "herbicide resistance protein" or a protein resulting from expression of an "herbicide resistance-encoding nucleic acid molecule" includes proteins that confer upon a cell the ability to tolerate a higher concentration of an herbicide than cells that do not express the protein, or to tolerate a certain concentration of an herbicide for a longer period of time than cells that do not express the protein. Herbicide resistance traits may be introduced into plants by genes coding for resistance to herbicides that act to inhibit the action of acetolactate synthase (ALS, also referred to as acetohydroxyacid synthase, AHAS), in particular the sulfonylurea (UK: sulphonylurea) type herbicides, genes coding for resistance to herbicides that act to inhibit the action of glutamine synthase, such as phosphinothricin or basta (e.g., the bar gene), glyphosate (e.g., the EPSP synthase gene and the GAT gene), HPPD inhibitors (e.g, the HPPD gene) or other such genes known in the art. See, for example, U.S. Pat. Nos. 7,626,077, 5,310,667, 5,866,775, 6,225,114, 6,248,876, 7,169,970, 6,867,293, and 9,187,762. The bar gene encodes resistance to the herbicide basta, the nptII gene encodes resistance to the antibiotics kanamycin and geneticin, and the ALS-gene mutants encode resistance to the herbicide chlorsulfuron.

Furthermore, it is recognized that the polynucleotide of interest may also comprise antisense sequences complementary to at least a portion of the messenger RNA (mRNA) for a targeted gene sequence of interest. Antisense nucleotides are constructed to hybridize with the corresponding mRNA. Modifications of the antisense sequences may be made as long as the sequences hybridize to and interfere with expression of the corresponding mRNA. In this manner, antisense constructions having 70%, 80%, or 85% sequence identity to the corresponding antisense sequences may be used. Furthermore, portions of the antisense nucleotides may be used to disrupt the expression of the target gene. Generally, sequences of at least 50 nucleotides, 100 nucleotides, 200 nucleotides, or greater may be used.

In addition, the polynucleotide of interest may also be used in the sense orientation to suppress the expression of endogenous genes in plants. Methods for suppressing gene expression in plants using polynucleotides in the sense orientation are known in the art. The methods generally involve transforming plants with a DNA construct comprising a promoter that drives expression in a plant operably linked to at least a portion of a nucleotide sequence that corresponds to the transcript of the endogenous gene. Typically, such a nucleotide sequence has substantial sequence identity to the sequence of the transcript of the endogenous gene, generally greater than about 65% sequence identity, about 85% sequence identity, or greater than about 95% sequence identity. See U.S. Pat. Nos. 5,283,184 and 5,034,323.

The polynucleotide of interest can also be a phenotypic marker. A phenotypic marker is screenable or a selectable marker that includes visual markers and selectable markers whether it is a positive or negative selectable marker. Any phenotypic marker can be used. Specifically, a selectable or screenable marker comprises a DNA segment that allows one to identify, or select for or against a molecule or a cell that comprises it, often under particular conditions. These markers can encode an activity, such as, but not limited to, production of RNA, peptide, or protein, or can provide a binding site for RNA, peptides, proteins, inorganic and organic compounds or compositions and the like.

Examples of selectable markers include, but are not limited to, DNA segments that comprise restriction enzyme sites; DNA segments that encode products which provide resistance against otherwise toxic compounds including antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as β-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Additional selectable markers include genes that confer resistance to herbicidal compounds, such as sulphonylureas, glufosinate ammonium, bromoxynil, imidazolinones, and 2,4-dichlorophenoxyacetate (2,4-D). See for example, Acetolactase synthase (ALS) for resistance to sulfonylureas, imidazolinones, triazolopyrimidine sulfonamides, pyrimidinylsalicylates and sulphonylaminocarbonyl-triazolinones (Shaner and Singh, 1997, Herbicide Activity: *Toxicol Biochem Mol Biol* 69-110); glyphosate resistant 5-enolpyruvylshikimate-3-phosphate (EPSPS) (Saroha et al. 1998, *J. Plant Biochemistry & Biotechnology* Vol 7:65-72);

Polynucleotides of interest includes genes that can be stacked or used in combination with other traits, such as but not limited to herbicide resistance or any other trait described herein. Polynucleotides of interest and/or traits can be stacked together in a complex trait locus as described in US20130263324 published 3 Oct. 2013 and in WO/2013/112686, published 1 Aug. 2013.

A polypeptide of interest includes any protein or polypeptide that is encoded by a polynucleotide of interest described herein.

Further provided are methods for identifying at least one plant cell, comprising in its genome, a polynucleotide of interest integrated at the target site. A variety of methods are available for identifying those plant cells with insertion into the genome at or near to the target site. Such methods can be viewed as directly analyzing a target sequence to detect any change in the target sequence, including but not limited to PCR methods, sequencing methods, nuclease digestion, Southern blots, and any combination thereof. See, for example, US20090133152 published 21 May 2009. The method also comprises recovering a plant from the plant cell comprising a polynucleotide of interest integrated into its genome. The plant may be sterile or fertile. It is recognized that any polynucleotide of interest can be provided, integrated into the plant genome at the target site, and expressed in a plant.

Optimization of Sequences for Expression in Plants

Methods are available in the art for synthesizing plant-preferred genes. See, for example, U.S. Pat. Nos. 5,380,831, and 5,436,391, and Murray et al. (1989) *Nucleic Acids Res.* 17:477-498. Additional sequence modifications are known to enhance gene expression in a plant host. These include, for example, elimination of: one or more sequences encoding spurious polyadenylation signals, one or more exon-intron splice site signals, one or more transposon-like repeats, and other such well-characterized sequences that may be deleterious to gene expression. The G-C content of the sequence may be adjusted to levels average for a given plant host, as calculated by reference to known genes expressed in the host plant cell. When possible, the sequence is modified to avoid one or more predicted hairpin secondary mRNA structures. Thus, "a plant-optimized nucleotide sequence" of the present disclosure comprises one or more of such sequence modifications.

Expression Elements

Any polynucleotide encoding a Cas protein or other CRISPR system component disclosed herein may be functionally linked to a heterologous expression element, to facilitate transcription or regulation in a host cell. Such expression elements include but are not limited to: promoter, leader, intron, and terminator. Expression elements may be "minimal"—meaning a shorter sequence derived from a native source, that still functions as an expression regulator or modifier. Alternatively, an expression element may be "optimized"—meaning that its polynucleotide sequence has been altered from its native state in order to function with a more desirable characteristic in a particular host cell. Alternatively, an expression element may be "synthetic"—meaning that it is designed in silico and synthesized for use in a host cell. Synthetic expression elements may be entirely synthetic, or partially synthetic (comprising a fragment of a naturally-occurring polynucleotide sequence).

It has been shown that certain promoters are able to direct RNA synthesis at a higher rate than others. These are called "strong promoters". Certain other promoters have been shown to direct RNA synthesis at higher levels only in particular types of cells or tissues and are often referred to as "tissue specific promoters", or "tissue-preferred promoters" if the promoters direct RNA synthesis preferably in certain tissues but also in other tissues at reduced levels.

A plant promoter includes a promoter capable of initiating transcription in a plant cell. For a review of plant promoters, see, Potenza et al., 2004, *In vitro Cell Dev Biol* 40:1-22; Porto et al., 2014, Molecular Biotechnology (2014), 56(1), 38-49.

Constitutive promoters include, for example, the core CaMV 35S promoter (Odell et al., (1985) *Nature* 313:810-2); rice actin (McElroy et al., (1990) *Plant Cell* 2:163-71); ubiquitin (Christensen et al., (1989) *Plant Mol Biol* 12:619-32; ALS promoter (U.S. Pat. No. 5,659,026) and the like.

Tissue-preferred promoters can be utilized to target enhanced expression within a particular plant tissue. Tissue-preferred promoters include, for example, WO2013103367 published 11 Jul. 2013, Kawamata et al., (1997) *Plant Cell Physiol* 38:792-803; Hansen et al., (1997) *Mol Gen Genet* 254:337-43; Russell et al., (1997) *Transgenic Res* 6:157-68; Rinehart et al., (1996) *Plant Physiol* 112:1331-41; Van Camp et al., (1996) *Plant Physiol* 112:525-35; Canevascini et al., (1996) *Plant Physiol* 112:513-524; Lam, (1994) *Results Probl Cell Differ* 20:181-96; and Guevara-Garcia et al., (1993) *Plant J* 4:495-505. Leaf-preferred promoters include, for example, Yamamoto et al., (1997) *Plant J* 12:255-65; Kwon et al., (1994) *Plant Physiol* 105:357-67; Yamamoto et al., (1994) *Plant Cell Physiol* 35:773-8; Gotor et al., (1993) *Plant J* 3:509-18; Orozco et al., (1993) *Plant Mol Biol* 23:1129-38; Matsuoka et al., (1993) *Proc. Natl. Acad. Sci. USA* 90:9586-90; Simpson et al., (1958) *EMBO J* 4:2723-9; Timko et al., (1988) *Nature* 318:57-8. Root-preferred promoters include, for example, Hire et al., (1992) *Plant Mol Biol* 20:207-18 (soybean root-specific glutamine synthase gene); Miao et al., (1991) *Plant Cell* 3:11-22 (cytosolic glutamine synthase (GS)); Keller and Baumgartner, (1991) *Plant Cell* 3:1051-61 (root-specific control element in the GRP 1.8 gene of French bean); Sanger et al., (1990) *Plant Mol Biol* 14:433-43 (root-specific promoter of *A. tumefaciens* mannopine synthase (MAS)); Bogusz et al., (1990) *Plant Cell* 2:633-41 (root-specific promoters isolated from *Parasponia andersonii* and *Trema tomentosa*); Leach and Aoyagi, (1991) *Plant Sci* 79:69-76 (*A. rhizogenes* rolC and rolD root-inducing genes); Teeri et al., (1989) *EMBO J* 8:343-50 (*Agrobacterium* wound-induced TR1' and TR2' genes); VfENOD-GRP3 gene promoter (Kuster et al., (1995) *Plant Mol Biol* 29:759-72); and rolB promoter (Capana et al., (1994) *Plant Mol Biol* 25:681-91; phaseolin gene (Murai et al., (1983) *Science* 23:476-82; Sengopta-Gopalen et al., (1988) *Proc. Natl. Acad. Sci. USA* 82:3320-4). See also, U.S. Pat. Nos. 5,837,876; 5,750,386; 5,633,363; 5,459,252; 5,401,836; 5,110,732 and 5,023,179.

Seed-preferred promoters include both seed-specific promoters active during seed development, as well as seed-germinating promoters active during seed germination. See, Thompson et al., (1989) *BioEssays* 10:108. Seed-preferred promoters include, but are not limited to, Cim1 (cytokinin-induced message); cZ19B1 (maize 19 kDa zein); and milps (myo-inositol-1-phosphate synthase); and for example, those disclosed in WO2000011177 published 2 Mar. 2000 and U.S. Pat. No. 6,225,529. For dicots, seed-preferred promoters include, but are not limited to, bean β-phaseolin, napin, β-conglycinin, soybean lectin, cruciferin, and the like. For monocots, seed-preferred promoters include, but are not limited to, maize 15 kDa zein, 22 kDa zein, 27 kDa gamma zein, waxy, shrunken 1, shrunken 2, globulin 1, oleosin, and nuc1. See also, WO2000012733 published 9 Mar. 2000, where seed-preferred promoters from END1 and END2 genes are disclosed.

Chemical inducible (regulated) promoters can be used to modulate the expression of a gene in a prokaryotic and eukaryotic cell or organism through the application of an exogenous chemical regulator. The promoter may be a chemical-inducible promoter, where application of the chemical induces gene expression, or a chemical-repressible promoter, where application of the chemical represses gene expression. Chemical-inducible promoters include, but are not limited to, the maize In2-2 promoter, activated by benzene sulfonamide herbicide safeners (De Veylder et al., (1997) *Plant Cell Physiol* 38:568-77), the maize GST promoter (GST-II-27, WO1993001294 published 21 Jan. 1993), activated by hydrophobic electrophilic compounds used as pre-emergent herbicides, and the tobacco PR-la promoter (Ono et al., (2004) *Biosci Biotechnol Biochem* 68:803-7) activated by salicylic acid. Other chemical-regulated promoters include steroid-responsive promoters (see, for example, the glucocorticoid-inducible promoter (Schena et al., (1991) *Proc. Natl. Acad. Sci. USA* 88:10421-5; McNellis et al., (1998) *Plant J* 14:247-257); tetracycline-inducible and tetracycline-repressible promoters (Gatz et al., (1991) *Mol Gen Genet* 227:229-37; U.S. Pat. Nos. 5,814,618 and 5,789,156).

Pathogen inducible promoters induced following infection by a pathogen include, but are not limited to those regulating expression of PR proteins, SAR proteins, beta-1, 3-glucanase, chitinase, etc.

A stress-inducible promoter includes the RD29A promoter (Kasuga et al. (1999) Nature Biotechnol. 17:287-91). One of ordinary skill in the art is familiar with protocols for simulating stress conditions such as drought, osmotic stress, salt stress and temperature stress and for evaluating stress tolerance of plants that have been subjected to simulated or naturally-occurring stress conditions.

Another example of an inducible promoter useful in plant cells, is the ZmCAS1 promoter, described in US20130312137 published 21 Nov. 2013.

New promoters of various types useful in plant cells are constantly being discovered; numerous examples may be found in the compilation by Okamuro and Goldberg, (1989) In *The Biochemistry of Plants*, Vol. 115, Stumpf and Conn, eds (New York, NY: Academic Press), pp. 1-82.

Modification of Genomes with Novel CRISPR-Cas System Components

As described herein, a guided Cas endonuclease can recognize, bind to a DNA target sequence and introduce a single strand (nick) or double-strand break. Once a single or double-strand break is induced in the DNA, the cell's DNA repair mechanism is activated to repair the break. Error-prone DNA repair mechanisms can produce mutations at double-strand break sites. The most common repair mechanism to bring the broken ends together is the nonhomologous end-joining (NHEJ) pathway (Bleuyard et al., (2006) *DNA Repair* 5:1-12). The structural integrity of chromosomes is typically preserved by the repair, but deletions, insertions, or other rearrangements (such as chromosomal translocations) are possible (Siebert and Puchta, 2002, *Plant Cell* 14:1121-31; Pacher et al., 2007, *Genetics* 175:21-9).

DNA double-strand breaks appear to be an effective factor to stimulate homologous recombination pathways (Puchta et al., (1995) *Plant Mol Biol* 28:281-92; Tzfira and White, (2005) *Trends Biotechnol* 23:567-9; Puchta, (2005) *J Exp Bot* 56:1-14). Using DNA-breaking agents, a two- to nine-fold increase of homologous recombination was observed between artificially constructed homologous DNA repeats in plants (Puchta et al., (1995) *Plant Mol Biol* 28:281-92). In maize protoplasts, experiments with linear DNA molecules demonstrated enhanced homologous recombination between plasmids (Lyznik et al., (1991) *Mol Gen Genet* 230:209-18).

Homology-directed repair (HDR) is a mechanism in cells to repair double-stranded and single stranded DNA breaks. Homology-directed repair includes homologous recombination (HR) and single-strand annealing (SSA) (Lieber. 2010 *Annu. Rev. Biochem.* 79:181-211). The most common form of HDR is called homologous recombination (HR), which has the longest sequence homology requirements between the donor and acceptor DNA. Other forms of HDR include single-stranded annealing (SSA) and breakage-induced replication, and these require shorter sequence homology relative to HR. Homology-directed repair at nicks (single-stranded breaks) can occur via a mechanism distinct from HDR at double-strand breaks (Davis and Maizels. *PNAS* (0027-8424), 111 (10), p. E924-E932).

Alteration of the genome of a prokaryotic and eukaryotic cell or organism cell, for example, through homologous recombination (HR), is a powerful tool for genetic engineering. Homologous recombination has been demonstrated in plants (Halfter et al., (1992) *Mol Gen Genet* 231:186-93) and insects (Dray and Gloor, 1997, *Genetics* 147:689-99). Homologous recombination has also been accomplished in other organisms. For example, at least 150-200 bp of homology was required for homologous recombination in the parasitic protozoan *Leishmania* (Papadopoulou and Dumas, (1997) *Nucleic Acids Res* 25:4278-86). In the filamentous fungus *Aspergillus nidulans*, gene replacement has been accomplished with as little as 50 bp flanking homology (Chaveroche et al., (2000) *Nucleic Acids Res* 28:e97). Targeted gene replacement has also been demonstrated in the ciliate Tetrahymena *thermophila* (Gaertig et al., (1994) *Nucleic Acids Res* 22:5391-8). In mammals, homologous recombination has been most successful in the mouse using pluripotent embryonic stem cell lines (ES) that can be grown in culture, transformed, selected and introduced into a mouse embryo (Watson et al., 1992, Recombinant DNA, 2nd Ed., Scientific American Books distributed by WH Freeman & Co.).

Gene Targeting

The guide polynucleotide/Cas systems described herein can be used for gene targeting.

In general, DNA targeting can be performed by cleaving one or both strands at a specific polynucleotide sequence in a cell with a Cas protein associated with a suitable polynucleotide component. Once a single or double-strand break is induced in the DNA, the cell's DNA repair mechanism is activated to repair the break via nonhomologous end-joining (NHEJ) or Homology-Directed Repair (HDR) processes which can lead to modifications at the target site.

The length of the DNA sequence at the target site can vary, and includes, for example, target sites that are at least 12, 13, 14, 15, 16, 17, 18, 19, 20, 21, 22, 23, 24, 25, 26, 27, 28, 29, 30, or more than 30 nucleotides in length. It is further possible that the target site can be palindromic, that is, the sequence on one strand reads the same in the opposite direction on the complementary strand. The nick/cleavage site can be within the target sequence or the nick/cleavage site could be outside of the target sequence. In another variation, the cleavage could occur at nucleotide positions immediately opposite each other to produce a blunt end cut or, in other cases, the incisions could be staggered to produce single-stranded overhangs, also called "sticky ends" or "staggered end", which can be either 5' overhangs, or 3' overhangs. Active variants of genomic target sites can also be used. Such active variants can comprise at least 65%, 70%, 75%, 80%, 85%, 90%, 91%, 92%, 93%, 94%, 95%, 96%, 97%, 98%, 99% or more sequence identity to the given target site, wherein the active variants retain biological activity and hence are capable of being recognized and cleaved by a Cas endonuclease.

Assays to measure the single or double-strand break of a target site by an endonuclease are known in the art and generally measure the overall activity and specificity of the agent on DNA substrates comprising recognition sites.

A targeting method herein can be performed in such a way that two or more DNA target sites are targeted in the method, for example. Such a method can optionally be characterized as a multiplex method. Two, three, four, five, six, seven, eight, nine, ten, or more target sites can be targeted at the same time in certain embodiments. A multiplex method is typically performed by a targeting method herein in which multiple different RNA components are provided, each designed to guide a guide polynucleotide/Cas endonuclease complex to a unique DNA target site.

Gene Editing

The process for editing a genomic sequence combining DSB and modification templates generally comprises: introducing into a host cell a DSB-inducing agent, or a nucleic acid encoding a DSB-inducing agent, that recognizes a target sequence in the chromosomal sequence and is able to induce a DSB in the genomic sequence, and at least one polynucleotide modification template comprising at least one nucleotide alteration when compared to the nucleotide sequence to be edited. The polynucleotide modification template can further comprise nucleotide sequences flanking the at least one nucleotide alteration, in which the flanking sequences are substantially homologous to the chromosomal region flanking the DSB. Genome editing using DSB-inducing agents, such as Cas-gRNA complexes, has been described, for example in US20150082478 published on 19 Mar. 2015, WO2015026886 published on 26 Feb. 2015, WO2016007347 published 14 Jan. 2016, and WO/2016/025131 published on 18 Feb. 2016.

Some uses for guide RNA/Cas endonuclease systems have been described (see for example: US20150082478 A1 published 19 Mar. 2015, WO2015026886 published 26 Feb. 2015, and US20150059010 published 26 Feb. 2015) and include but are not limited to modifying or replacing nucleotide sequences of interest (such as a regulatory elements), insertion of polynucleotides of interest, gene knock-out, gene-knock in, modification of splicing sites and/or introducing alternate splicing sites, modifications of nucleotide sequences encoding a protein of interest, amino acid and/or protein fusions, and gene silencing by expressing an inverted repeat into a gene of interest.

Proteins may be altered in various ways including amino acid substitutions, deletions, truncations, and insertions. Methods for such manipulations are generally known. For example, amino acid sequence variants of the protein(s) can be prepared by mutations in the DNA. Methods for mutagenesis and nucleotide sequence alterations include, for example, Kunkel, (1985) *Proc. Natl. Acad. Sci. USA* 82:488-92; Kunkel et al., (1987) *Meth Enzymol* 154:367-82; U.S. Pat. No. 4,873,192; Walker and Gaastra, eds. (1983) *Techniques in Molecular Biology* (MacMillan Publishing Company, New York) and the references cited therein. Guidance regarding amino acid substitutions not likely to affect biological activity of the protein is found, for example, in the model of Dayhoff et al., (1978) *Atlas of Protein Sequence and Structure* (Natl Biomed Res Found, Washington, D.C.). Conservative substitutions, such as exchanging one amino acid with another having similar properties, may be preferable. Conservative deletions, insertions, and amino acid substitutions are not expected to produce radical changes in the characteristics of the protein, and the effect of any substitution, deletion, insertion, or combination thereof can be evaluated by routine screening assays. Assays for double-strand-break-inducing activity are known and generally measure the overall activity and specificity of the agent on DNA substrates comprising target sites.

Described herein are methods for genome editing with CRISPR Associated (Cas) endonucleases. Following characterization of the guide RNA (or guide polynucleotide) and PAM sequence, a ribonucleoprotein (RNP) complex comprising the Cas endonuclease and the guide RNA (or guide polynucleotide) may be utilized to modify a target polynucleotide, including but not limited to: synthetic DNA, isolated genomic DNA, or chromosomal DNA in other organisms, including plants. To facilitate optimal expression and nuclear localization (for eukaryotic cells), the gene comprising the Cas endonuclease may be optimized, and then delivered into cells as DNA expression cassettes by methods known in the art. The components necessary to comprise an active RNP may also be delivered as RNA with or without modifications that protect the RNA from degradation or as mRNA capped or uncapped (Zhang, Y. et al., 2016, *Nat. Commun.* 7:12617) or Cas protein guide polynucleotide complexes (WO2017070032 published 27 Apr. 2017), or any combination thereof. Additionally, a part or part(s) of the complex may be expressed from a DNA construct while other components are delivered as RNA with or without modifications that protect the RNA from degradation or as mRNA capped or uncapped (Zhang et al. 2016 *Nat. Commun.* 7:12617) or Cas protein guide polynucleotide complexes (WO2017070032 published 27 Apr. 2017) or any combination thereof. To produce crRNAs in-vivo, tRNA derived elements may also be used to recruit endogenous RNAses to cleave crRNA transcripts into mature forms capable of guiding the complex to its DNA target site, as described, for example, in WO2017105991 published 22 Jun. 2017. Furthermore, the cleavage activity of the Cas endonuclease may be deactivated by altering key catalytic residues in its cleavage domain (Sinkunas, T. et al., 2013, *EMBO J.* 32:385-394) resulting in a RNA guided helicase that may be used to enhance homology directed repair, induce transcriptional activation, or remodel local DNA structures. Moreover, the activity of the Cas cleavage and helicase domains may both be knocked-out and used in combination with other DNA cutting, DNA nicking, DNA binding, transcriptional activation, transcriptional repression, DNA remodeling, DNA deamination, DNA unwinding, DNA recombination enhancing, DNA integration, DNA inversion, and DNA repair agents.

The transcriptional direction of the tracrRNA for the CRISPR-Cas system (if present) and other components of the CRISPR-Cas system (such as variable targeting domain, crRNA repeat, loop, anti-repeat) can be deduced as described in WO2016186946 published 24 Nov. 2016, and WO2016186953 published 24 Nov. 2016.

As described herein, once the appropriate guide RNA requirement is established, the PAM preferences for each new system disclosed herein may be examined. If the cleavage RNP complex (comprising the Cas endonuclease and guide polynucleotide) results in degradation of the randomized PAM library, the complex can be converted into a nickase by disabling activity either through mutagenesis of critical residues or by assembling the reaction in the absence of ATP as described previously (Sinkunas, T. et al., 2013, *EMBO J.* 32:385-394). Two regions of PAM randomization separated by two protospacer targets may be utilized to generate a double-stranded DNA break which may be captured and sequenced to examine the PAM sequences that support cleavage by the complex.

In one embodiment, the invention describes a method for modifying a target site in the genome of a cell, the method comprising introducing into a cell at least one PGEN described herein, and identifying at least one cell that has a modification at said target, wherein the modification at said target site is selected from the group consisting of (i) a replacement of at least one nucleotide, (ii) a deletion of at least one nucleotide, (iii) an insertion of at least one nucleotide, and (iv) any combination of (i)-(iii).

The nucleotide to be edited can be located within or outside a target site recognized and cleaved by a Cas endonuclease. In one embodiment, the at least one nucleotide modification is not a modification at a target site recognized and cleaved by a Cas endonuclease. In another embodiment, there are at least 1, 2, 3, 4, 5, 6, 7, 8, 9, 10, 11, 12, 13, 14, 15, 16, 17, 18, 19, 20, 21, 22, 23, 24, 25, 26, 27, 30, 40, 50, 100, 200, 300, 400, 500, 600, 700, 900 or 1000 nucleotides between the at least one nucleotide to be edited and the genomic target site.

A knock-out may be produced by an indel (insertion or deletion of nucleotide bases in a target DNA sequence through NHEJ), or by specific removal of sequence that reduces or completely destroys the function of sequence at or near the targeting site.

A guide polynucleotide/Cas endonuclease induced targeted mutation can occur in a nucleotide sequence that is located within or outside a genomic target site that is recognized and cleaved by the Cas endonuclease.

The method for editing a nucleotide sequence in the genome of a cell can be a method without the use of an exogenous selectable marker by restoring function to a non-functional gene product.

In one embodiment, the invention describes a method for modifying a target site in the genome of a cell, the method comprising introducing into a cell at least one PGEN described herein and at least one donor DNA, wherein said donor DNA comprises a polynucleotide of interest, and optionally, further comprising identifying at least one cell that said polynucleotide of interest integrated in or near said target site.

In one aspect, the methods disclosed herein may employ homologous recombination (HR) to provide integration of the polynucleotide of interest at the target site.

Various methods and compositions can be employed to produce a cell or organism having a polynucleotide of interest inserted in a target site via activity of a CRISPR-Cas system component described herein. In one method described herein, a polynucleotide of interest is introduced into the organism cell via a donor DNA construct. As used herein, "donor DNA" is a DNA construct that comprises a polynucleotide of interest to be inserted into the target site of a Cas endonuclease. The donor DNA construct further comprises a first and a second region of homology that flank the polynucleotide of interest. The first and second regions of homology of the donor DNA share homology to a first and a second genomic region, respectively, present in or flanking the target site of the cell or organism genome.

The donor DNA can be tethered to the guide polynucleotide. Tethered donor DNAs can allow for co-localizing target and donor DNA, useful in genome editing, gene insertion, and targeted genome regulation, and can also be useful in targeting post-mitotic cells where function of endogenous HR machinery is expected to be highly diminished (Mali et al., 2013, *Nature Methods Vol.* 10: 957-963).

The amount of homology or sequence identity shared by a target and a donor polynucleotide can vary and includes total lengths and/or regions having unit integral values in the ranges of about 1-20 bp, 20-50 bp, 50-100 bp, 75-150 bp, 100-250 bp, 150-300 bp, 200-400 bp, 250-500 bp, 300-600 bp, 350-750 bp, 400-800 bp, 450-900 bp, 500-1000 bp, 600-1250 bp, 700-1500 bp, 800-1750 bp, 900-2000 bp, 1-2.5 kb, 1.5-3 kb, 2-4 kb, 2.5-5 kb, 3-6 kb, 3.5-7 kb, 4-8 kb, 5-10 kb, or up to and including the total length of the target site. These ranges include every integer within the range, for example, the range of 1-20 bp includes 1, 2, 3, 4, 5, 6, 7, 8, 9, 10, 11, 12, 13, 14, 15, 16, 17, 18, 19 and 20 bps. The amount of homology can also be described by percent sequence identity over the full aligned length of the two polynucleotides which includes percent sequence identity of about at least 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. Sufficient homology includes any combination of polynucleotide length, global percent sequence identity, and optionally conserved regions of contiguous nucleotides or local percent sequence identity, for example sufficient homology can be described as a region of 75-150 bp having at least 80% sequence identity to a region of the target locus. Sufficient homology can also be described by the predicted ability of two polynucleotides to specifically hybridize under high stringency conditions, see, for example, Sambrook et al., (1989) *Molecular Cloning: A Laboratory Manual*, (Cold Spring Harbor Laboratory Press, NY); *Current Protocols in Molecular Biology*, Ausubel et al., Eds (1994) Current Protocols, (Greene Publishing Associates, Inc. and John Wiley & Sons, Inc.); and, Tijssen (1993) *Laboratory Techniques in Biochemistry and Molecular Biology—Hybridization with Nucleic Acid Probes*, (Elsevier, New York).

Episomal DNA molecules can also be ligated into the double-strand break, for example, integration of T-DNAs into chromosomal double-strand breaks (Chilton and Que, (2003) *Plant Physiol* 133:956-65; Salomon and Puchta, (1998) *EMBO J.* 17:6086-95). Once the sequence around the double-strand breaks is altered, for example, by exonuclease activities involved in the maturation of double-strand breaks, gene conversion pathways can restore the original structure if a homologous sequence is available, such as a homologous chromosome in non-dividing somatic cells, or a sister chromatid after DNA replication (Molinier et al., (2004) *Plant Cell* 16:342-52). Ectopic and/or epigenic DNA sequences may also serve as a DNA repair template for homologous recombination (Puchta, (1999) *Genetics* 152: 1173-81).

In one embodiment, the disclosure comprises a method for editing a nucleotide sequence in the genome of a cell, the method comprising introducing into at least one PGEN described herein, and a polynucleotide modification template, wherein said polynucleotide modification template comprises at least one nucleotide modification of said nucleotide sequence, and optionally further comprising selecting at least one cell that comprises the edited nucleotide sequence.

The guide polynucleotide/Cas endonuclease system can be used in combination with at least one polynucleotide modification template to allow for editing (modification) of a genomic nucleotide sequence of interest. (See also US20150082478, published 19 Mar. 2015 and WO2015026886 published 26 Feb. 2015).

Polynucleotides of interest and/or traits can be stacked together in a complex trait locus as described in WO2012129373 published 27 Sep. 2012, and in WO2013112686, published 1 Aug. 2013. The guide polynucleotide/Cas endonuclease system described herein provides for an efficient system to generate double-strand breaks and allows for traits to be stacked in a complex trait locus.

A guide polynucleotide/Cas system as described herein, mediating gene targeting, can be used in methods for directing heterologous gene insertion and/or for producing complex trait loci comprising multiple heterologous genes in a fashion similar as disclosed in WO2012129373 published 27 Sep. 2012, where instead of using a double-strand break inducing agent to introduce a gene of interest, a guide polynucleotide/Cas system as disclosed herein is used. By inserting independent transgenes within 0.1, 0.2, 0.3, 0.4, 0.5, 1.0, 2, or even 5 centimorgans (cM) from each other, the transgenes can be bred as a single genetic locus (see, for example, US20130263324 published 3 Oct. 2013 or WO2012129373 published 14 Mar. 2013). After selecting a plant comprising a transgene, plants comprising (at least) one transgenes can be crossed to form an F1 that comprises both transgenes. In progeny from these F1 (F2 or BC1) 1/500 progeny would have the two different transgenes recombined onto the same chromosome. The complex locus can then be bred as single genetic locus with both transgene traits. This process can be repeated to stack as many traits as desired.

Further uses for guide RNA/Cas endonuclease systems have been described (See for example: US20150082478 published 19 Mar. 2015, WO2015026886 published 26 Feb. 2015, US20150059010 published 26 Feb. 2015, WO2016007347 published 14 Jan. 2016, and PCT application WO2016025131 published 18 Feb. 2016) and include but are not limited to modifying or replacing nucleotide sequences of interest (such as a regulatory elements), insertion of polynucleotides of interest, gene knock-out, gene-knock in, modification of splicing sites and/or introducing alternate splicing sites, modifications of nucleotide sequences encoding a protein of interest, amino acid and/or protein fusions, and gene silencing by expressing an inverted repeat into a gene of interest.

Resulting characteristics from the gene editing compositions and methods described herein may be evaluated. Chromosomal intervals that correlate with a phenotype or trait of interest can be identified. A variety of methods well known in the art are available for identifying chromosomal intervals. The boundaries of such chromosomal intervals are drawn to encompass markers that will be linked to the gene controlling the trait of interest. In other words, the chromosomal interval is drawn such that any marker that lies within that interval (including the terminal markers that define the boundaries of the interval) can be used as a marker for a particular trait. In one embodiment, the chromosomal interval comprises at least one QTL, and furthermore, may indeed comprise more than one QTL. Close proximity of multiple QTLs in the same interval may obfuscate the correlation of a particular marker with a particular QTL, as one marker may demonstrate linkage to more than one QTL. Conversely, e.g., if two markers in close proximity show co-segregation with the desired phenotypic trait, it is sometimes unclear if each of those markers identifies the same QTL or two different QTL. The term "quantitative trait locus" or "QTL" refers to a region of DNA that is associated with the differential expression of a quantitative phenotypic trait in at least one genetic background, e.g., in at least one breeding population. The region of the QTL encompasses or is closely linked to the gene or genes that affect the trait in question. An "allele of a QTL" can comprise multiple genes or other genetic factors within a contiguous genomic region or linkage group, such as a haplotype. An allele of a QTL can denote a haplotype within a specified window wherein said window is a contiguous genomic region that can be defined, and tracked, with a set of one or more polymorphic markers. A haplotype can be defined by the unique fingerprint of alleles at each marker within the specified window.

In addition to the double-strand break inducing agents, site-specific base conversions can also be achieved to engineer one or more nucleotide changes to create one or more edits into the genome. These include for example, a site-specific base edit mediated by an C•G to T•A or an A•T to G•C base editing deaminase enzymes (Gaudelli et al., Programmable base editing of A•T to G•C in genomic DNA without DNA cleavage." Nature (2017); Nishida et al. "Targeted nucleotide editing using hybrid prokaryotic and vertebrate adaptive immune systems." Science 353 (6305) (2016); Komor et al. "Programmable editing of a target base in genomic DNA without double-stranded DNA cleavage." Nature 533 (7603) (2016):420-4. A catalytically "dead" or inactive Cas9 (dCas9), for example a catalytically inactive "dead" version of a Cas9 ortholog disclosed herein, fused to a cytidine deaminase or an adenine deaminase protein becomes a specific base editor that can alter DNA bases without inducing a DNA break. Base editors convert C→T (or G→A on the opposite strand) or an adenine base editor that would convert adenine to inosine, resulting in an A→G change within an editing window specified by the gRNA.

Introduction of CRISPR-Cas System Components into a Cell

The methods and compositions described herein do not depend on a particular method for introducing a sequence into an organism or cell, only that the polynucleotide or polypeptide gains access to the interior of at least one cell of the organism. Introducing includes reference to the incorporation of a nucleic acid into a eukaryotic or prokaryotic cell where the nucleic acid may be incorporated into the genome of the cell, and includes reference to the transient (direct) provision of a nucleic acid, protein or polynucleotide-protein complex (PGEN, RGEN) to the cell.

Methods for introducing polynucleotides or polypeptides or a polynucleotide-protein complex into cells or organisms are known in the art including, but not limited to, microinjection, electroporation, stable transformation methods, transient transformation methods, ballistic particle acceleration (particle bombardment), whiskers mediated transformation, Agrobacterium-mediated transformation, direct gene transfer, viral-mediated introduction, transfection, transduction, cell-penetrating peptides, mesoporous silica nanoparticle (MSN)-mediated direct protein delivery, topical applications, sexual crossing, sexual breeding, and any combination thereof.

For example, the guide polynucleotide (guide RNA, crNucleotide+tracrNucleotide, guide DNA and/or guide RNA-DNA molecule) can be introduced into a cell directly (transiently) as a single stranded or double stranded polynucleotide molecule. The guide RNA (or crRNA+tracrRNA) can also be introduced into a cell indirectly by introducing a recombinant DNA molecule comprising a heterologous nucleic acid fragment encoding the guide RNA (or crRNA+tracrRNA), operably linked to a specific promoter that is capable of transcribing the guide RNA (crRNA+tracrRNA molecules) in said cell. The specific promoter can be, but is not limited to, a RNA polymerase III promoter, which allow for transcription of RNA with precisely defined, unmodified, 5'- and 3'-ends (Ma et al., 2014, *Mol. Ther. Nucleic Acids* 3:e161; DiCarlo et al., 2013, *Nucleic Acids Res.* 41: 4336-4343; WO2015026887, published 26 Feb. 2015). Any promoter capable of transcribing the guide RNA in a cell can be used and includes a heat shock/heat inducible promoter operably linked to a nucleotide sequence encoding the guide RNA.

The Cas endonuclease, such as the Cas endonuclease described herein, can be introduced into a cell by directly introducing the Cas polypeptide itself (referred to as direct delivery of Cas endonuclease), the mRNA encoding the Cas protein, and/or the guide polynucleotide/Cas endonuclease complex itself, using any method known in the art. The Cas endonuclease can also be introduced into a cell indirectly by introducing a recombinant DNA molecule that encodes the Cas endonuclease. The endonuclease can be introduced into a cell transiently or can be incorporated into the genome of the host cell using any method known in the art. Uptake of the endonuclease and/or the guided polynucleotide into the cell can be facilitated with a Cell Penetrating Peptide (CPP) as described in WO2016073433 published 12 May 2016. Any promoter capable of expressing the Cas endonuclease in a cell can be used and includes a heat shock/heat inducible promoter operably linked to a nucleotide sequence encoding the Cas endonuclease.

Direct delivery of a polynucleotide modification template into plant cells can be achieved through particle mediated delivery, and any other direct method of delivery, such as but not limiting to, polyethylene glycol (PEG)-mediated transfection to protoplasts, whiskers mediated transformation, electroporation, particle bombardment, cell-penetrating peptides, or mesoporous silica nanoparticle (MSN)-mediated direct protein delivery can be successfully used for delivering a polynucleotide modification template in eukaryotic cells, such as plant cells.

The donor DNA can be introduced by any means known in the art. The donor DNA may be provided by any transformation method known in the art including, for example, Agrobacterium-mediated transformation or biolistic particle bombardment. The donor DNA may be present transiently in the cell or it could be introduced via a viral replicon. In the presence of the Cas endonuclease and the target site, the donor DNA is inserted into the transformed plant's genome.

Direct delivery of any one of the guided Cas system components can be accompanied by direct delivery (co-delivery) of other mRNAs that can promote the enrichment and/or visualization of cells receiving the guide polynucleotide/Cas endonuclease complex components. For example, direct co-delivery of the guide polynucleotide/Cas endonuclease components (and/or guide polynucleotide/Cas endonuclease complex itself) together with mRNA encoding phenotypic markers (such as but not limiting to transcriptional activators such as CRC (Bruce et al. 2000 *The Plant Cell* 12:65-79) can enable the selection and enrichment of cells without the use of an exogenous selectable marker by restoring function to a non-functional gene product as described in WO2017070032 published 27 Apr. 2017.

Introducing a guide RNA/Cas endonuclease complex described herein, into a cell includes introducing the individual components of said complex either separately or combined into the cell, and either directly (direct delivery as RNA for the guide and protein for the Cas endonuclease and Cas protein subunits, or functional fragments thereof) or via recombination constructs expressing the components (guide RNA, Cas endonuclease, Cas protein subunits, or functional fragments thereof). Introducing a guide RNA/Cas endonuclease complex (RGEN) into a cell includes introducing the guide RNA/Cas endonuclease complex as a ribonucleotide-protein into the cell. The ribonucleotide-protein can be assembled prior to being introduced into the cell as described herein. The components comprising the guide RNA/Cas endonuclease ribonucleotide protein (at least one Cas endonuclease, at least one guide RNA, at least one Cas protein subunits) can be assembled in vitro or assembled by any means known in the art prior to being introduced into a cell (targeted for genome modification as described herein).

Plant cells differ from human and animal cells in that plant cells comprise a plant cell wall which may act as a barrier to the direct delivery of the RGEN ribonucleoproteins and/or of the direct delivery of the RGEN components.

Direct delivery of the RGEN ribonucleoproteins into plant cells can be achieved through particle mediated delivery (particle bombardment. Based on the experiments described herein, a skilled artesian can now envision that any other direct method of delivery, such as but not limiting to, polyethylene glycol (PEG)-mediated transfection to protoplasts, electroporation, cell-penetrating peptides, or mesoporous silica nanoparticle (MSN)-mediated direct protein delivery, can be successfully used for delivering RGEN ribonucleoproteins into plant cells.

Direct delivery of the RGEN ribonucleoprotein, allows for genome editing at a target site in the genome of a cell which can be followed by rapid degradation of the complex, and only a transient presence of the complex in the cell. This transient presence of the RGEN complex may lead to reduced off-target effects. In contrast, delivery of RGEN components (guide RNA, Cas endonuclease) via plasmid DNA sequences can result in constant expression of RGENs from these plasmids which can intensify off target effects (Cradick, T. J. et al. (2013) *Nucleic Acids Res* 41:9584-9592; Fu, Y et al. (2014) *Nat. Biotechnol.* 31:822-826).

Direct delivery can be achieved by combining any one component of the guide RNA/Cas endonuclease complex (RGEN) (such as at least one guide RNA, at least one Cas protein, and at least one Cas protein), with a particle delivery matrix comprising a microparticle (such as but not limited to of a gold particle, tungsten particle, and silicon carbide whisker particle) (see also WO2017070032 published 27 Apr. 2017).

In one aspect, the guide polynucleotide/Cas endonuclease complex is a complex wherein the guide RNA and Cas endonuclease protein forming the guide RNA/Cas endonuclease complex are introduced into the cell as RNA and protein, respectively.

In one aspect, the guide polynucleotide/Cas endonuclease complex is a complex wherein the guide RNA and Cas endonuclease protein and the at least one protein subunit of a Cas protein forming the guide RNA/Cas endonuclease complex are introduced into the cell as RNA and proteins, respectively.

In one aspect, the guide polynucleotide/Cas endonuclease complex is a complex wherein the guide RNA and Cas endonuclease protein and the at least one protein subunit of a Cascade forming the guide RNA/Cas endonuclease complex (cleavage ready cascade) are preassembled in vitro and introduced into the cell as a ribonucleotide-protein complex.

Protocols for introducing polynucleotides, polypeptides or polynucleotide-protein complexes (PGEN, RGEN) into eukaryotic cells, such as plants or plant cells are known and include microinjection (Crossway et al., (1986) *Biotechniques* 4:320-34 and U.S. Pat. No. 6,300,543), meristem transformation (U.S. Pat. No. 5,736,369), electroporation (Riggs et al., (1986) *Proc. Natl. Acad. Sci. USA* 83:5602-6, *Agrobacterium*-mediated transformation (U.S. Pat. Nos. 5,563,055 and 5,981,840), whiskers mediated transformation (Ainley et al. 2013, *Plant Biotechnology Journal* 11:1126-1134; Shaheen A. and M. Arshad 2011 Properties and Applications of Silicon Carbide (2011), 345-358 Editor(s): Gerhardt, Rosario. Publisher: InTech, Rijeka, Croatia. CODEN: 69PQBP; ISBN: 978-953-307-201-2), direct gene transfer (Paszkowski et al., (1984) *EMBO J* 3:2717-22), and ballistic particle acceleration (U.S. Pat. Nos. 4,945,050; 5,879,918; 5,886,244; 5,932,782; Tomes et al., (1995) "Direct DNA Transfer into Intact Plant Cells via Microprojectile Bombardment" in *Plant Cell, Tissue, and Organ Culture: Fundamental Methods*, ed. Gamborg & Phillips (Springer-Verlag, Berlin); McCabe et al., (1988) *Biotechnology* 6:923-6; Weissinger et al., (1988) *Ann Rev Genet* 22:421-77; Sanford et al., (1987) *Particulate Science and Technology* 5:27-37 (onion); Christou et al., (1988) *Plant Physiol* 87:671-4 (soybean); Finer and McMullen, (1991) *In vitro Cell Dev Biol* 27P:175-82 (soybean); Singh et al., (1998) *Theor Appl Genet* 96:319-24 (soybean); Datta et al., (1990) *Biotechnology* 8:736-40 (rice); Klein et al., (1988) *Proc. Natl. Acad. Sci. USA* 85:4305-9 (maize); Klein et al., (1988) *Biotechnology* 6:559-63 (maize); U.S. Pat. Nos. 5,240,855; 5,322,783 and 5,324,646; Klein et al., (1988) *Plant Physiol* 91:440-4 (maize); Fromm et al., (1990) *Biotechnology* 8:833-9 (maize); Hooykaas-Van Slogteren et al., (1984) *Nature* 311:763-4; U.S. Pat. No. 5,736,369 (cereals); Bytebier et al., (1987) *Proc. Natl. Acad. Sci. USA* 84:5345-9 (Liliaceae); De Wet et al., (1985) in *The Experimental Manipulation of Ovule Tissues*, ed. Chapman et al., (*Longman*, New York), pp. 197-209 (pollen); Kaeppler et al., (1990) *Plant Cell Rep* 9:415-8) and Kaeppler et al., (1992) *Theor Appl Genet* 84:560-6 (whisker-mediated transformation); D'Halluin et al., (1992) *Plant Cell* 4:1495-505 (electroporation); Li et al., (1993) *Plant Cell Rep* 12:250-5; Christou and Ford (1995) *Annals Botany* 75:407-13 (rice) and Osjoda et al., (1996) *Nat Biotechnol* 14:745-50 (maize via *Agrobacterium tumefaciens*).

Alternatively, polynucleotides may be introduced into plant or plant cells by contacting cells or organisms with a virus or viral nucleic acids. Generally, such methods involve incorporating a polynucleotide within a viral DNA or RNA molecule. In some examples a polypeptide of interest may be initially synthesized as part of a viral polyprotein, which is later processed by proteolysis in vivo or in vitro to produce the desired recombinant protein. Methods for introducing polynucleotides into plants and expressing a protein encoded therein, involving viral DNA or RNA molecules, are known, see, for example, U.S. Pat. Nos. 5,889,191, 5,889,190, 5,866,785, 5,589,367 and 5,316,931.

The polynucleotide or recombinant DNA construct can be provided to or introduced into a prokaryotic and eukaryotic cell or organism using a variety of transient transformation methods. Such transient transformation methods include, but are not limited to, the introduction of the polynucleotide construct directly into the plant.

Nucleic acids and proteins can be provided to a cell by any method including methods using molecules to facilitate the uptake of anyone or all components of a guided Cas system (protein and/or nucleic acids), such as cell-penetrating peptides and nanocarriers. See also US20110035836 published 10 Feb. 2011, and EP2821486A1 published 7 Jan. 2015.

Other methods of introducing polynucleotides into a prokaryotic and eukaryotic cell or organism or plant part can be used, including plastid transformation methods, and the methods for introducing polynucleotides into tissues from seedlings or mature seeds.

Stable transformation is intended to mean that the nucleotide construct introduced into an organism integrates into a genome of the organism and is capable of being inherited by the progeny thereof. Transient transformation is intended to mean that a polynucleotide is introduced into the organism and does not integrate into a genome of the organism or a polypeptide is introduced into an organism. Transient transformation indicates that the introduced composition is only temporarily expressed or present in the organism.

A variety of methods are available to identify those cells having an altered genome at or near a target site without using a screenable marker phenotype. Such methods can be viewed as directly analyzing a target sequence to detect any change in the target sequence, including but not limited to PCR methods, sequencing methods, nuclease digestion, Southern blots, and any combination thereof.

The presently disclosed polynucleotides and polypeptides can be introduced into a cell. Cells include, but are not limited to, human, non-human, animal, mammalian, bacterial, protist, fungal, insect, yeast, non-conventional yeast, and plant cells, as well as plants and seeds produced by the methods described herein. In some aspects, the cell of the organism is a reproductive cell, a somatic cell, a meiotic cell, a mitotic cell, a stem cell, or a pluripotent stem cell.

Cells and Plants

The presently disclosed polynucleotides and polypeptides can be introduced into a plant cell. Plant cells include, well as plants and seeds produced by the methods described herein. Any plant can be used with the compositions and methods described herein, including monocot and dicot plants, and plant elements.

The novel Cas9 orthologs disclosed may be used to edit the genome of a plant cell in various ways. In one aspect, it may be desirable to delete one or more nucleotides. In another aspect, it may be desirable to insert one or more nucleotides. In one aspect, it may be desirable to replace one or more nucleotides. In another aspect, it may be desirable to modify one or more nucleotides via a covalent or non-covalent interaction with another atom or molecule. In some aspects, the cell is diploid. In some aspects, the cell is haploid.

Genome modification via a Cas9 ortholog may be used to effect a genotypic and/or phenotypic change on the target organism. Such a change is preferably related to an improved trait of interest or an agronomically-important characteristic, the correction of an endogenous defect, or the expression of some type of expression marker. In some aspects, the trait of interest or agronomically-important characteristic is related to the overall health, fitness, or fertility of the plant, the yield of a plant product, the ecological fitness of the plant, or the environmental stability of the plant. In some aspects, the trait of interest or agronomically-important characteristic is selected from the group consisting of: agronomics, herbicide resistance, insecticide resistance, disease resistance, nematode resistance, microbial resistance, fungal resistance, viral resistance, fertility or sterility, grain characteristics, commercial product production. In some aspects, the trait of interest or agronomically-important characteristic is selected from the group consisting of: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein content, altered starch content, altered carbohydrate content, altered sugar content, altered fiber content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition, as compared to an isoline plant not comprising a modification derived from the methods or compositions herein.

Examples of monocot plants that can be used include, but are not limited to, corn (*Zea mays*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), wheat (*Triticum* species, for example *Triticum aestivum, Triticum monococcum*), sugarcane (*Saccharum* spp.), oats (*Avena*), barley (*Hordeum*), switchgrass (*Panicum virgatum*), pineapple (*Ananas comosus*), banana (*Musa* spp.), palm, ornamentals, turfgrasses, and other grasses.

Examples of dicot plants that can be used include, but are not limited to, soybean (*Glycine max*), *Brassica* species (for example but not limited to: oilseed rape or Canola) (*Brassica napus, B. campestris, Brassica rapa, Brassica juncea*), alfalfa (*Medicago sativa*), tobacco (*Nicotiana tabacum*), Arabidopsis (*Arabidopsis thaliana*), sunflower (*Helianthus annuus*), cotton (*Gossypium arboreum, Gossypium barbadense*), and peanut (*Arachis hypogaea*), tomato (*Solanum lycopersicum*), potato (*Solanum tuberosum*).

Additional plants that can be used include safflower (*Carthamus tinctorius*), sweet potato (*Ipomoea batatus*), cassava (*Manihot esculenta*), coffee (*Coffea* spp.), coconut (*Cocos nucifera*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), vegetables, ornamentals, and conifers.

Vegetables that can be used include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rho-*

*dodendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be used include pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow cedar (*Chamaecyparis nootkatensis*).

In certain embodiments of the disclosure, a fertile plant is a plant that produces viable male and female gametes and is self-fertile. Such a self-fertile plant can produce a progeny plant without the contribution from any other plant of a gamete and the genetic material comprised therein. Other embodiments of the disclosure can involve the use of a plant that is not self-fertile because the plant does not produce male gametes, or female gametes, or both, that are viable or otherwise capable of fertilization.

The present disclosure finds use in the breeding of plants comprising one or more introduced traits, or edited genomes.

A non-limiting example of how two traits can be stacked into the genome at a genetic distance of, for example, 5 cM from each other is described as follows: A first plant comprising a first transgenic target site integrated into a first DSB target site within the genomic window and not having the first genomic locus of interest is crossed to a second transgenic plant, comprising a genomic locus of interest at a different genomic insertion site within the genomic window and the second plant does not comprise the first transgenic target site. About 5% of the plant progeny from this cross will have both the first transgenic target site integrated into a first DSB target site and the first genomic locus of interest integrated at different genomic insertion sites within the genomic window. Progeny plants having both sites in the defined genomic window can be further crossed with a third transgenic plant comprising a second transgenic target site integrated into a second DSB target site and/or a second genomic locus of interest within the defined genomic window and lacking the first transgenic target site and the first genomic locus of interest. Progeny are then selected having the first transgenic target site, the first genomic locus of interest and the second genomic locus of interest integrated at different genomic insertion sites within the genomic window. Such methods can be used to produce a transgenic plant comprising a complex trait locus having at least 1, 2, 3, 4, 5, 6, 7, 8, 9, 10, 11, 12, 13, 14, 15, 16, 17, 19, 19, 20, 21, 22, 23, 24, 25, 26, 27, 28, 29, 30, 31 or more transgenic target sites integrated into DSB target sites and/or genomic loci of interest integrated at different sites within the genomic window. In such a manner, various complex trait loci can be generated.

Cells and Animals

The presently disclosed polynucleotides and polypeptides can be introduced into an animal cell. Animal cells can include, but are not limited to: an organism of a phylum including chordates, arthropods, mollusks, annelids, cnidarians, or echinoderms; or an organism of a class including mammals, insects, birds, amphibians, reptiles, or fishes. In some aspects, the animal is human, mouse, *C. elegans*, rat, fruit fly (*Drosophila* spp.), zebrafish, chicken, dog, cat, guinea pig, hamster, chicken, Japanese ricefish, sea lamprey, pufferfish, tree frog (e.g., *Xenopus* spp.), monkey, or chimpanzee. Particular cell types that are contemplated include haploid cells, diploid cells, reproductive cells, neurons, muscle cells, endocrine or exocrine cells, epithelial cells, muscle cells, tumor cells, embryonic cells, hematopoietic cells, bone cells, germ cells, somatic cells, stem cells, pluripotent stem cells, induced pluripotent stem cells, progenitor cells, meiotic cells, and mitotic cells. In some aspects, a plurality of cells from an organism may be used.

The novel Cas9 orthologs disclosed may be used to edit the genome of an animal cell in various ways. In one aspect, it may be desirable to delete one or more nucleotides. In another aspect, it may be desirable to insert one or more nucleotides. In one aspect, it may be desirable to replace one or more nucleotides. In another aspect, it may be desirable to modify one or more nucleotides via a covalent or non-covalent interaction with another atom or molecule.

Genome modification via a Cas9 ortholog may be used to effect a genotypic and/or phenotypic change on the target organism. Such a change is preferably related to an improved phenotype of interest or a physiologically-important characteristic, the correction of an endogenous defect, or the expression of some type of expression marker. In some aspects, the phenotype of interest or physiologically-important characteristic is related to the overall health, fitness, or fertility of the animal, the ecological fitness of the animal, or the relationship or interaction of the animal with other organisms in its environment. In some aspects, the phenotype of interest or physiologically-important characteristic is selected from the group consisting of: improved general health, disease reversal, disease modification, disease stabilization, disease prevention, treatment of parasitic infections, treatment of viral infections, treatment of retroviral infections, treatment of bacterial infections, treatment of neurological disorders (for example but not limited to: multiple sclerosis), correction of endogenous genetic defects (for example but not limited to: metabolic disorders, Achondroplasia, Alpha-1 Antitrypsin Deficiency, Antiphospholipid Syndrome, Autism, Autosomal Dominant Polycystic Kidney Disease, Barth syndrome, Breast cancer, Charcot-Marie-Tooth, Colon cancer, Cri du chat, Crohn's Disease, Cystic fibrosis, Dercum Disease, Down Syndrome, Duane Syndrome, Duchenne Muscular Dystrophy, Factor V Leiden Thrombophilia, Familial Hypercholesterolemia, Familial Mediterranean Fever, Fragile X Syndrome, Gaucher Disease, Hemochromatosis, Hemophilia, Holoprosencephaly, Huntington's disease, Klinefelter syndrome, Marfan syndrome, Myotonic Dystrophy, Neurofibromatosis, Noonan Syndrome, Osteogenesis Imperfecta, Parkinson's disease, Phenylketonuria, Poland Anomaly, Porphyria, Progeria, Prostate Cancer, Retinitis Pigmentosa, Severe Combined Immunodeficiency (SCID), Sickle cell disease, Skin Cancer, Spinal Muscular Atrophy, Tay-Sachs, Thalassemia, Trimethylaminuria, Turner Syndrome, Velocardiofacial Syndrome, WAGR Syndrome, and Wilson Disease), treatment of innate immune disorders (for example but not limited to: immunoglobulin subclass deficiencies), treatment of acquired immune disorders (for example but not limited to: AIDS and other HIV-related disorders), treatment of cancer, as well as treatment of diseases, including rare or "orphan" conditions, that have eluded effective treatment options with other methods.

Cells that have been genetically modified using the compositions or methods disclosed herein may be transplanted to a subject for purposes such as gene therapy, e.g. to treat a disease, or as an antiviral, antipathogenic, or anticancer therapeutic, for the production of genetically modified organisms in agriculture, or for biological research.

In Vitro Polynucleotide Detection, Binding, and Modification

The compositions disclosed herein may further be used as compositions for use in in vitro methods, in some aspects with isolated polynucleotide sequence(s). Said isolated polynucleotide sequence(s) may comprise one or more target sequence(s) for modification. In some aspects, said isolated polynucleotide sequence(s) may be genomic DNA, a PCR product, or a synthesized oligonucleotide.

Compositions

Modification of a target sequence may be in the form of a nucleotide insertion, a nucleotide deletion, a nucleotide substitution, the addition of an atom molecule to an existing nucleotide, a nucleotide modification, or the binding of a heterologous polynucleotide or polypeptide to said target sequence. The insertion of one or more nucleotides may be accomplished by the inclusion of a donor polynucleotide in the reaction mixture: said donor polynucleotide is inserted into a double-strand break created by said Cas9 ortholog polypeptide. The insertion may be via non-homologous end joining or via homologous recombination.

In one aspect, the sequence of the target polynucleotide is known prior to modification, and compared to the sequence(s) of polynucleotide(s) that result from treatment with the Cas9 ortholog. In one aspect, the sequence of the target polynucleotide is not known prior to modification, and the treatment with the Cas9 ortholog is used as part of a method to determine the sequence of said target polynucleotide.

Polynucleotide modification with a Cas9 ortholog may be accomplished by usage of a full-length polypeptide identified from a Cas locus, or from a fragment, modification, or variant of a polypeptide identified from a Cas locus. In some aspects, said Cas9 ortholog is obtained or derived from an organism listed in Table 1. In some aspects, said Cas9 ortholog is a polypeptide sharing at least 80% identity with any of SEQ ID NOs:86-170 or 511-1135. In some aspects, said Cas9 ortholog is a functional variant of any of SEQ ID NOs:86-170 or 511-1135. In some aspects, said Cas9 ortholog is a functional fragment of any of SEQ ID NOs: 86-170 or 511-1135. In some aspects, said Cas9 ortholog is a Cas9 polypeptide encoded by a polynucleotide selected from the group consisting of: SEQ ID NO:86-170 or 511-1135. In some aspects, said Cas9 ortholog is a Cas9 polypeptide that recognizes a PAM sequence listed in any of Tables 4-83. In some aspects, said Cas9 ortholog is a Cas9 polypeptide identified from an organism listed in the sequence listing.

In some aspects, the Cas9 ortholog is provided as a cas9 polynucleotide. In some aspects, said cas9 polynucleotide is selected from the group consisting of: SEQ ID NO:1-85, or a sequence sharing at least 80%, 85%, 90%, 95%, 97%, 99%, or 100% with any one of SEQ ID NO:1-85.

In some aspects, the Cas9 ortholog may be selected from the group consisting of: an unmodified wild type Cas9 ortholog, a functional Cas9 ortholog variant, a functional Cas9 ortholog fragment, a fusion protein comprising an active or deactivated Cas9 ortholog, a Cas9 ortholog further comprising one or more nuclear localization sequences (NLS) on the C-terminus or on the N-terminus or on both the N- and C-termini, a biotinylated Cas9 ortholog, a Cas9 ortholog nickase, a Cas9 ortholog endonuclease, a Cas9 ortholog further comprising a Histidine tag, and a mixture of any two or more of the preceding.

In some aspects, the Cas9 ortholog is a fusion protein further comprising a nuclease domain, a transcriptional activator domain, a transcriptional repressor domain, an epigenetic modification domain, a cleavage domain, a nuclear localization signal, a cell-penetrating domain, a translocation domain, a marker, or a transgene that is heterologous to the target polynucleotide sequence or to the cell from which said target polynucleotide sequence is obtained or derived.

In some aspects, a plurality of Cas9 orthologs may be desired. In some aspects, said plurality may comprise Cas9 orthologs derived from different source organisms or from different loci within the same organism. In some aspects, said plurality may comprise Cas9 orthologs with different binding specificities to the target polynucleotide. In some aspects, said plurality may comprise Cas9 orthologs with different cleavage efficiencies. In some aspects, said plurality may comprise Cas9 orthologs with different PAM specificities. In some aspects, said plurality may comprise orthologs of different molecular compositions, i.e., a polynucleotide cas9 ortholog and a polypeptide Cas9 ortholog.

The guide polynucleotide may be provided as a single guide RNA (sgRNA), a chimeric molecule comprising a tracrRNA, a chimeric molecule comprising a crRNA, a chimeric RNA-DNA molecule, a DNA molecule, or a polynucleotide comprising one or more chemically modified nucleotides.

The storage conditions of the Cas9 ortholog and/or the guide polynucleotide include parameters for temperature, state of matter, and time. In some aspects, the Cas9 ortholog and/or the guide polynucleotide is stored at about −80 degrees Celsius, at about −20 degrees Celsius, at about 4 degrees Celsius, at about 20-25 degrees Celsius, or at about 37 degrees Celsius. In some aspects, the Cas9 ortholog and/or the guide polynucleotide is stored as a liquid, a frozen liquid, or as a lyophilized powder. In some aspects, the Cas9 ortholog and/or the guide polynucleotide is stable for at least one day, at least one week, at least one month, at least one year, or even greater than one year.

Any or all of the possible polynucleotide components of the reaction (e.g., guide polynucleotide, donor polynucleotide, optionally a cas9 polynucleotide) may be provided as part of a vector, a construct, a linearized or circularized plasmid, or as part of a chimeric molecule. Each component may be provided to the reaction mixture separately or together. In some aspects, one or more of the polynucleotide components are operably linked to a heterologous noncoding regulatory element that regulates its expression.

The method for modification of a target polynucleotide comprises combining the minimal elements into a reaction mixture comprising: a Cas9 ortholog (or variant, fragment, or other related molecule as described above), a guide polynucleotide comprising a sequence that is substantially complementary to, or selectively hybridizes to, the target polynucleotide sequence of the target polynucleotide, and a target polynucleotide for modification. In some aspects, the Cas9 ortholog is provided as a polypeptide. In some aspects, the Cas9 ortholog is provided as a cas9 ortholog polynucleotide. In some aspects, the guide polynucleotide is provided as an RNA molecule, a DNA molecule, an RNA:DNA hybrid, or a polynucleotide molecule comprising a chemically-modified nucleotide.

The storage buffer of any one of the components, or the reaction mixture, may be optimized for stability, efficacy, or other parameters. Additional components of the storage buffer or the reaction mixture may include a buffer composition, Tris, EDTA, dithiothreitol (DTT), phosphate-buffered saline (PBS), sodium chloride, magnesium chloride, HEPES, glycerol, BSA, a salt, an emulsifier, a detergent, a chelating agent, a redox reagent, an antibody, nuclease-free water, a proteinase, and/or a viscosity agent. In some aspects, the storage buffer or reaction mixture further comprises a buffer solution with at least one of the following components: HEPES, MgCl2, NaCl, EDTA, a proteinase, Proteinase K, glycerol, nuclease-free water.

Incubation conditions will vary according to desired outcome. The temperature is preferably at least 10 degrees Celsius, between 10 and 15, at least 15, between 15 and 17, at least 17, between 17 and 20, at least 20, between 20 and 22, at least 22, between 22 and 25, at least 25, between 25 and 27, at least 27, between 27 and 30, at least 30, between 30 and 32, at least 32, between 32 and 35, at least 35, at least 36, at least 37, at least 38, at least 39, at least 40, or even greater than 40 degrees Celsius. The time of incubation is at least 1 minute, at least 2 minutes, at least 3 minutes, at least 4 minutes, at least 5 minutes, at least 6 minutes, at least 7 minutes, at least 8 minutes, at least 9 minutes, at least 10 minutes, or even greater than 10 minutes.

The sequence(s) of the polynucleotide(s) in the reaction mixture prior to, during, or after incubation may be determined by any method known in the art. In one aspect, modification of a target polynucleotide may be ascertained by comparing the sequence(s) of the polynucleotide(s) purified from the reaction mixture to the sequence of the target polynucleotide prior to combining with the Cas9 ortholog.

Any one or more of the compositions disclosed herein, useful for in vitro or in vivo polynucleotide detection, binding, and/or modification, may be comprised within a kit. A kit comprises a Cas9 ortholog or a polynucleotide cas9 ortholog encoding such, optionally further comprising buffer components to enable efficient storage, and one or more additional compositions that enable the introduction of said Cas9 ortholog or cas9 ortholog to a heterologous polynucleotide, wherein said Cas9 ortholog or cas9 ortholog is capable of effecting a modification, addition, deletion, or substitution of at least one nucleotide of said heterologous polynucleotide. In an additional aspect, a Cas9 ortholog disclosed herein may be used for the enrichment of one or more polynucleotide target sequences from a mixed pool. In an additional aspect, a Cas9 ortholog disclosed herein may be immobilized on a matrix for use in in vitro target polynucleotide detection, binding, and/or modification.

Methods of Detection

Methods of detecting the Cas9:guide polynucleotide complex bound to the target polynucleotide may include any known in the art, including but not limited to microscopy, chromatographic separation, electrophoresis, immunoprecipitation, filtration, nanopore separation, microarrays, as well as those described below.

A DNA Electrophoretic Mobility Shift Assay (EMSA): studies proteins binding to known DNA oligonucleotide probes and assesses the specificity of the interaction. The technique is based on the principle that protein-DNA complexes migrate more slowly than free DNA molecules when subjected to polyacrylamide or agarose gel electrophoresis. Because the rate of DNA migration is retarded upon protein binding, the assay is also called a gel retardation assay. Adding a protein-specific antibody to the binding components creates an even larger complex (antibody-protein-DNA) which migrates even slower during electrophoresis, this is known as a supershift and can be used to confirm protein identities.

DNA Pull-down Assays use a DNA probe labelled with a high affinity tag, such as biotin, which allows the probe to be recovered or immobilized. A DNA probe can be complexed with a protein from a cell lysate in a reaction similar to that used in the EMSA and then used to purify the complex using agarose or magnetic beads. The proteins are then eluted from the DNA and detected by Western blot or identified by mass spectrometry. Alternatively, the protein may be labelled with an affinity tag or the DNA-protein complex may be isolated using an antibody against the protein of interest (similar to a supershift assay). In this case, the unknown DNA sequence bound by the protein is detected by Southern blotting or through PCR analysis.

Reporter assays provide a real-time in vivo read-out of translational activity for a promoter of interest. Reporter genes are fusions of a target promoter DNA sequence and a reporter gene DNA sequence which is customized by the researcher and the DNA sequence codes for a protein with detectable properties like firefly/*Renilla* luciferase or alkaline phosphatase. These genes produce enzymes only when the promoter of interest is activated. The enzyme, in turn, catalyses a substrate to produce either light or a colour change that can be detected by spectroscopic instrumentation. The signal from the reporter gene is used as an indirect determinant for the translation of endogenous proteins driven from the same promoter.

Microplate Capture and Detection Assays use immobilized DNA probes to capture specific protein-DNA interactions and confirm protein identities and relative amounts with target specific antibodies. Typically, a DNA probe is immobilized on the surface of 96- or 384-well microplates coated with streptavidin. A cellular extract is prepared and added to allow the binding protein to bind to the oligonucleotide. The extract is then removed and each well is washed several times to remove non-specifically bound proteins. Finally, the protein is detected using a specific antibody labelled for detection. This method can be extremely sensitive, detecting less than 0.2 pg of the target protein per well. This method may also be utilized for oligonucleotides labelled with other tags, such as primary amines that can be immobilized on microplates coated with an amine-reactive surface chemistry.

DNA Footprinting is one of the most widely used methods for obtaining detailed information on the individual nucleotides in protein—DNA complexes, even inside living cells. In such an experiment, chemicals or enzymes are used to modify or digest the DNA molecules. • When sequence specific proteins bind to DNA they can protect the binding sites from modification or digestion. This can subsequently be visualized by denaturing gel electrophoresis, where unprotected DNA is cleaved more or less at random. Therefore it appears as a 'ladder' of bands and the sites protected by proteins have no corresponding bands and look like foot prints in the pattern of bands. The foot prints there by identify specific nucleosides at the protein—DNA binding sites.

Microscopic techniques include optical, fluorescence, electron, and atomic force microscopy (AFM).

Chromatin immunoprecipitation analysis (ChIP) causes proteins to bind covalently to their DNA targets, after which they are unlinked and characterized separately.

Systematic Evolution of Ligands by EXponential enrichment (SELEX) exposes target proteins to a random library of oligonucleotides. Those genes that bind are separated and amplified by PCR.

NON-LIMITING ASPECTS

Aspect 1: A synthetic composition comprising a cas9 polynucleotide selected from the group consisting of: (a) a polynucleotide sharing at least 80% identity with any of: SEQ ID NOS:86-170 or 511-1135, (b) a functional variant of any of SEQ ID NOS:86-170 or 511-1135, (c) a functional fragment of any of SEQ ID NOS:86-170 or 511-1135, (d) a cas9 gene encoding a Cas9 polypeptide selected from the group consisting of: SEQ ID NO:86-170, (e) a cas9 gene encoding a Cas9 polypeptide that recognizes a PAM sequence listed in any of Tables 4-83, and (f) a cas9 gene identified from an organism listed in Table 1; and a heterologous component.

Aspect 2: A synthetic composition comprising a Cas9 polypeptide selected from the group consisting of: (a) a polypeptide sharing at least 80% identity with any of: SEQ ID NO:86-170 or 511-1135, (b) a functional variant of any of SEQ ID NO:86-170 or 511-1135, (c) a functional fragment of any of SEQ ID NO:86-170, (d) a Cas9 polypeptide encoded by a polynucleotide selected from the group consisting of: SEQ ID NOS:86-170 or 511-1135, (e) a Cas9 polypeptide that recognizes a PAM sequence listed in any of Tables 4-83, and (f) a Cas9 polypeptide identified from an organism listed in Table 1 or in the sequence listing; and a heterologous component.

Aspect 3: A deactivated Cas9 polypeptide wherein said deactivated Cas9 polypeptide is capable of binding to a target polynucleotide but lacks at least one domain responsible for nucleotide cleavage.

Aspect 4: A synthetic fusion protein comprising a Cas9 polypeptide and a heterologous polypeptide, wherein said Cas9 polypeptide is selected from the group consisting of:

Aspect 5: A synthetic composition comprising a single guide RNA selected from the group consisting of: (a) a polynucleotide sharing at least 80% identity with any of: SEQ ID NO:426-510, (b) a functional variant of any of: SEQ ID NO:426-510, (c) a functional fragment of any of: SEQ ID NO:426-510, and (d) a single guide RNA molecule identified or derived from an organism listed in Table 1; and a heterologous component.

Aspect 6: A synthetic composition comprising a tracrRNA selected from the group consisting of: (a) a polynucleotide sharing at least 80% identity with any of: SEQ ID NO:341-425, (b) a functional variant of any of: SEQ ID NO:341-425, (c) a functional fragment of any of: SEQ ID NO:341-425, and (d) a tracrRNA molecule identified from an organism listed in Table 1; and a heterologous component.

Aspect 7: A synthetic composition comprising a crRNA repeat sequence selected from the group consisting of: (a) a polynucleotide sharing at least 80% identity with any of: SEQ ID NO:171-255, (b) a functional variant of any of: SEQ ID NO:171-255, (c) a functional fragment of any of: SEQ ID NO:171-255, and (d) a crRNA repeat sequence molecule identified from an organism listed in Table 1; and a heterologous component.

Aspect 8: A synthetic composition comprising an anti-repeat sequence selected from the group consisting of: (a) a polynucleotide sharing at least 80% identity with any of: SEQ ID NO:256-340, (b) a functional variant of any of: SEQ ID NO:256-340, (c) a functional fragment of any of: SEQ ID NO:256-340, and (d) an anti-repeat sequence molecule identified from an organism listed in Table 1; and a heterologous component.

Aspect 9: A synthetic composition comprising a polypeptide sharing at least 80% identity with a polypeptide selected from the group consisting of SEQ ID NO:86-170 and a polynucleotide selected from the group consisting of: (a) a polynucleotide sharing at least 80% identity with a polynucleotide selected from the group consisting of SEQ ID NO: 171-255, (b) a polynucleotide sharing at least 80% identity with a polynucleotide selected from the group consisting of SEQ ID NO: 341-425, and (c) a polynucleotide sharing at least 80% identity with a polynucleotide selected from the group consisting of SEQ ID NO: 426-510; wherein said synthetic composition further comprises a heterologous component.

Aspect 10: A synthetic composition comprising a guide polynucleotide and Cas9 ortholog, wherein said Cas9 ortholog is selected from the group consisting of: (a) the deactivated Cas9 polypeptide of Aspect 3, (b) a polypeptide sharing at least 80% identity with any of: SEQ ID NO:86-170 or 511-1135, (c) a functional variant of any of SEQ ID NO:86-170 or 511-1135, (d) a functional fragment of any of SEQ ID NO:86-170 or 511-1135, (e) a Cas9 polypeptide that recognizes a PAM sequence listed in any of Tables 4-83, (f) a Cas9 polypeptide identified from an organism listed in Table 1, (g) a cas9 polynucleotide selected from the group consisting of: SEQ ID NOS:86-170 or 511-1135, and (h) a cas9 polynucleotide encoding any of the polypeptides of (a) through (f); and said guide polynucleotide is selected from the group consisting of: (i) a single guide RNA sharing at least 80% identity with a sequence selected from the group consisting of SEQ ID NOs:426-510, (j) a single guide RNA comprising a functional fragment of SEQ ID NOs:426-510, (k) a single guide RNA comprising a functional variant of SEQ ID NOs:426-510, (l) a single guide RNA comprising a chimeric non-naturally occurring crRNA linked to a tracrRNA, wherein said tracrRNA comprises a nucleotide sequence selected from the group consisting of SEQ ID NOs:341-425, a functional fragment of SEQ ID NOs:341-425, and a functional variant of SEQ ID NOs:341-425, (m) a single guide RNA comprises a chimeric non-naturally occurring crRNA linked to a tracrRNA, wherein said chimeric non-naturally occurring crRNA comprises a nucleotide sequence selected from the group consisting of SEQ ID NOs:171-255, a functional fragment of SEQ ID NOs:171-255, and a functional variant of SEQ ID NOs:171-255, (n) a guide RNA that is a duplex molecule comprising a chimeric non-naturally occurring crRNA and a tracrRNA, wherein said chimeric non-naturally occurring crRNA comprises a variable targeting domain capable of hybridizing to said target sequence, wherein said tracrRNA comprises a nucleotide sequence selected from the group consisting of SEQ ID NOs:341-425, a functional fragment of SEQ ID NOs:341-425, and a functional variant of SEQ ID NOs:341-425, wherein said chimeric non-naturally occurring crRNA comprises a variable targeting domain capable of hybridizing to said target sequence, (o) a guide RNA that is a duplex molecule comprising a chimeric non-naturally occurring crRNA and a tracrRNA, wherein said chimeric non-naturally occurring crRNA comprises a nucleotide sequence selected from the group consisting of SEQ ID NOs:171-255, a functional fragment of SEQ ID NOs:171-255, and a functional variant of SEQ ID NOs:171-255, wherein said chimeric non-naturally occurring crRNA comprises a variable targeting domain capable of hybridizing to said target sequence, (p) a polynucleotide comprising both DNA and RNA, (q) a polynucleotide comprising at least one chemically-modified nucleotide, and (r) a DNA molecule encoding any of the RNA molecules of (h) through (n); wherein said guide polynucleotide and said Cas 9 ortholog are capable of forming a complex that is capable of recognizing, binding to, and optionally nicking or cleaving a target polynucleotide sequence; further comprising at least one heterologous component.

Aspect 11: The guide polynucleotide/Cas9 endonuclease complex of Aspect 10, wherein said target polynucleotide sequence is located in the genome of a cell.

Aspect 12: The guide polynucleotide/Cas9 endonuclease complex of Aspect 10, wherein said target polynucleotide sequence is isolated from a genomic environment.

Aspect 13: The guide polynucleotide/Cas9 endonuclease complex of Aspect 10, wherein said target polynucleotide sequence is synthetic.

Aspect 14: The synthetic composition of any of Aspects 1-10, wherein said heterologous component is selected from the group consisting of: a heterologous polynucleotide, a heterologous polypeptide, a particle, a solid matrix, an antibody, a buffer composition, Tris, EDTA, dithiothreitol (DTT), phosphate-buffered saline (PBS), sodium chloride, magnesium chloride, HEPES, glycerol, bovine serum albumin (BSA), a salt, an emulsifier, a detergent, a chelating agent, a redox reagent, an antibody, nuclease-free water, a viscosity agent, and a Histidine tag.

Aspect 15: The synthetic composition of Aspect 14, wherein said heterologous polypeptide comprises a nuclease domain, a transcriptional activator domain, a transcriptional repressor domain, an epigenetic modification domain, a cleavage domain, a nuclear localization signal, a cell-penetrating domain, a deaminase domain, a base editing domain, a translocation domain, a marker, and a transgene.

Aspect 16: The synthetic composition of Aspect 14, wherein said heterologous polynucleotide is selected from the group consisting of: a guide polynucleotide, a chimeric guide polynucleotide, a chemically modified guide polynucleotide, a guide polynucleotide comprising both DNA and RNA, a noncoding expression element, a gene, a marker, and a polynucleotide encoding a plurality of Histidine residues.

Aspect 17: The synthetic composition of Aspect 14, comprising at least two different said heterologous components.

Aspect 18: The synthetic composition of Aspect 14, wherein the pH is between 1.0 and 14.0, between 2.0 and 13.0, between 3.0 and 12.0, between 4.0 and 11.0, between 5.0 and 10.0, between 6.0 and 9.0, between 7.0 and 8.0, between 4.5 and 6.5, between 5.5 and 7.5, or between 6.5 and 7.5.

Aspect 19: The synthetic composition of Aspect 14, wherein said Cas9 ortholog has an activity optimum at a pH between 1.0 and 14.0, between 2.0 and 13.0, between 3.0 and 12.0, between 4.0 and 11.0, between 5.0 and 10.0, between 6.0 and 9.0, between 7.0 and 8.0, between 4.5 and 6.5, between 5.5 and 7.5, or between 6.5 and 7.5.

Aspect 20: The synthetic composition of Aspect 14, wherein said Cas9 ortholog has an activity optimum at a temperature between 0 degrees Celsius and 100 degrees Celsius, between at least 0 degrees Celsius and 10 degrees Celsius, between at least 10 degrees Celsius and 20 degrees Celsius, between at least 20 degrees Celsius and 25 degrees Celsius, between at least 25 degrees Celsius and 30 degrees Celsius, between at least 30 degrees Celsius and 40 degrees Celsius, between at least 40 degrees Celsius and 50 degrees Celsius, between at least 50 degrees Celsius and 60 degrees Celsius, between at least 60 degrees Celsius and 70 degrees Celsius, between at least 70 degrees Celsius and 80 degrees Celsius, between at least 80 degrees Celsius and 90 degrees Celsius, between at least 90 degrees Celsius and 100 degrees Celsius, or 100 degrees Celsius.

Aspect 21: The synthetic composition of Aspect 14, stored or incubated at a temperature of at least minus 200 degrees Celsius, at least minus 150 degrees Celsius, at least minus 135 degrees Celsius, at least minus 90 degrees Celsius, at least minus 80 degrees Celsius, at least minus 20 degrees Celsius, at least 4 degrees Celsius, at least 17 degrees Celsius, at least 25 degrees Celsius, at least 30 degrees Celsius, at least 35 degrees Celsius, at least 37 degrees Celsius, at least 39 degrees Celsius, or greater than 39 degrees Celsius.

Aspect 22: A substantially nuclease-free, endotoxin-free composition comprising the synthetic composition of any of Aspects 1-10.

Aspect 23: A lyophilized composition comprising the synthetic composition of Aspect 10 or Aspect 15.

Aspect 24: A cell comprising the synthetic composition of any of Aspects 1-10.

Aspect 25: A progeny cell of the cell of Aspect 23, wherein said progeny cell comprises at least one modification of its genome compared to the target polynucleotide site of the parental cell.

Aspect 26: The cell of Aspect 24, selected from the group consisting of: human, non-human primate, mammal, animal, archaeal, bacterial, protist, fungal, insect, yeast, non-conventional yeast, and plant.

Aspect 27: The human cell of Aspect 26, wherein said human cell is selected from the group consisting of: haploid cells, diploid cells, reproductive cells, neurons, muscle cells, endocrine or exocrine cells, epithelial cells, muscle cells, tumor cells, embryonic cells, hematopoietic cells, bone cells, germ cells, somatic cells, stem cells, pluripotent stem cells, induced pluripotent stem cells, progenitor cells, meiotic cells, and mitotic cells.

Aspect 28: The plant cell of Aspect 26, wherein the plant cell is selected from the group consisting of a monocot and dicot cell.

Aspect 29: The plant cell of Aspect 26, wherein the plant cell is selected from the group consisting of maize, rice, sorghum, rye, barley, wheat, millet, oats, sugarcane, turfgrass, switchgrass, soybean, canola, alfalfa, sunflower, cotton, tobacco, peanut, potato, tobacco, *Arabidopsis*, vegetable, and safflower cell.

Aspect 30: The synthetic composition of Aspect 2, wherein said Cas9 endonuclease has been modified to lack at least one nuclease domain.

Aspect 31: The synthetic composition of Aspect 2, wherein said Cas9 endonuclease has been modified to lack endonuclease activity.

Aspect 32: A kit comprising the lyophilized composition of Aspect 23 or the synthetic composition of Aspect 22.

Aspect 33: An in vitro method of detecting a target polynucleotide sequence, comprising: (a) obtaining said target polynucleotide, (b) combining a Cas9 ortholog polypeptide, a guide polynucleotide, and said target polynucleotide in a reaction vessel, (c) incubating the components of step (b) at a temperature of at least 10 degrees Celsius for at least 1 minute, (d) sequencing the resulting polynucleotide(s) in the reaction mixture, and (e) characterizing the sequence of the target polynucleotide of step (a) that was identified by the Cas9 ortholog polypeptide and the guide polynucleotide; wherein said guide polynucleotide comprises a polynucleotide sequence that is substantially complementary to the sequence of the target polynucleotide.

Aspect 34: An in vitro method of binding a Cas9 ortholog and guide polynucleotide complex to a target polynucleotide, comprising: (a) obtaining the sequence of said target polynucleotide, (b) combining a Cas9 ortholog polypeptide, a guide polynucleotide, and said target polynucleotide in a reaction vessel, (c) incubating the components of step (b) at a temperature of at least 10 degrees Celsius for at least 1 minute; wherein said guide polynucleotide comprises a polynucleotide sequence that is substantially complementary to the target polynucleotide sequence of the target polynucleotide; further comprising detecting the Cas9 ortholog and guide polynucleotide complex bound to the target polynucleotide.

Aspect 35: The method of Aspect 34, wherein said Cas9 ortholog further comprises a detectable fusion protein domain, a histidine tag, or a chemical marker.

Aspect 36: The method of Aspect 34, wherein detecting said Cas9 ortholog and guide polynucleotide complex bound to the target polynucleotide further comprises a step comprising an enzyme-linked immunosorbent assay, a radioimmunoassay, affinity chromatography, size exclusion chromatography, ion exchange chromatography, hydrophobic interaction chromatography, electrophoretic mobility shift assay, chromatin immunoprecipitation assay, yeast one-hybrid system, bacterial one-hybrid system, x-ray crystallography, pull-down assay, reporter assay, marker expression assay, microplate capture assay, and DNA footprinting.

Aspect 37: An in vitro method of modifying a target polynucleotide, comprising: (a) obtaining the sequence of said target polynucleotide, (b) combining a Cas9 ortholog polypeptide, a guide polynucleotide, and said target polynucleotide in a reaction vessel, (c) incubating the components of step (b) at a temperature of at least 10 degrees Celsius for at least 1 minute, (d) sequencing the resulting polynucleotide(s) in the reaction mixture, and (e) identifying at least one sequence modification of said resulting polynucleotide(s) as compared to the sequence of the target polynucleotide obtained in step (a); wherein said guide polynucleotide comprises a polynucleotide sequence that is substantially complementary to the target polynucleotide sequence of the target polynucleotide.

Aspect 38: The method of any of Aspects 33, 34, or 37, wherein said target polynucleotide was obtained or derived from a host organism prior to the incubation of step (c), and re-introduced back into the same host organism after the incubation of step (c).

Aspect 39: The method of any of Aspects 33, 34, or 37, wherein said Cas9 ortholog polypeptide is adhered to a solid matrix.

Aspect 40: The method of any of Aspects 33, 34, or 37, wherein said Cas9 ortholog polypeptide is a nuclease, a nickase, or lacks either nuclease or nickase activity.

Aspect 41: The method of Aspect 33, wherein said target polynucleotide was obtained or derived from a host organism prior to the incubation of step (c), and introduced into a different organism after the incubation of step (c).

Aspect 42: The method of Aspect 33, wherein said Cas9 ortholog polypeptide is selected from the group consisting of: an unmodified wild type Cas9 ortholog, a functional Cas9 ortholog variant, a functional Cas9 ortholog fragment, a fusion protein comprising an active or deactivated Cas9 ortholog, a Cas9 ortholog further comprising one or more nuclear localization sequences (NLS) on the C-terminus or on the N-terminus or on both the N- and C-termini, a biotinylated Cas9 ortholog, a Cas9 ortholog nickase, a Cas9 ortholog endonuclease, a Cas9 ortholog further comprising a Histidine tag, a plurality of Cas9 orthologs, and a mixture of any two or more of the preceding.

Aspect 43: The method of Aspect 33, wherein said Cas9 ortholog polypeptide is selected from the group consisting of: (a) a polypeptide sharing at least 80% identity with any of: SEQ ID NO:86-170, (b) a functional variant of any of SEQ ID NO:86-170, (c) a functional fragment of any of SEQ ID NO:86-170, (d) a Cas9 polypeptide encoded by a polynucleotide selected from the group consisting of: SEQ ID NOS:86-170 or 511-1135, (e) a Cas9 polypeptide that recognizes a PAM sequence listed in any of Tables 4-83, and (f) a Cas9 polypeptide identified from an organism listed in Table 1.

Aspect 44: The method of Aspect 33, further comprising a composition selected from the group consisting of: 200 mM HEPES, 50 mM MgCl2, 1M NaCl, and 1 mM EDTA, a proteinase, Proteinase K, and nuclease-free water.

Aspect 45: The method of Aspect 33, wherein said modification is selected from the group consisting of: an insertion, a deletion, a substitution, and the addition or association of an atom or molecule to an existing nucleotide.

Aspect 46: The method of Aspect 33, further comprising a donor polynucleotide, wherein said donor polynucleotide is inserted into a double-strand break created by said Cas9 ortholog polypeptide.

Aspect 47: An in vivo method of modifying a target polynucleotide sequence, comprising providing to a cell a composition comprising the synthetic composition of any one of
Aspects 1-10, wherein said cell comprises in its genome a polynucleotide sequence capable of being recognized, bound to, and cleaved said composition.

Aspect 48: A method for modifying a target site in the genome of a cell, the method comprising providing to said cell at least one Cas9 ortholog selected from the group consisting of: (a) the deactivated Cas9 polypeptide of Aspect 3, (b) a polypeptide sharing at least 80% identity with any of: SEQ ID NO:86-170, (c) a functional variant of any of SEQ ID NO:86-170, (d) a functional fragment of any of SEQ ID NO:86-170, (e) a Cas9 polypeptide that recognizes a PAM sequence listed in any of Tables 4-83, (f) a Cas9 polypeptide identified from an organism listed in Table 1, (g) a Cas9 polypeptide encoded by a cas9 polynucleotide selected from the group consisting of: SEQ ID NOS:86-170 or 511-1135, and (h) a Cas9 polypeptide encoding any of the polypeptides of (a) through (g); and said guide polynucleotide is selected from the group consisting of: (i) a single guide RNA sharing at least 80% identity with a sequence selected from the group consisting of SEQ ID NOs:426-510, (j) a single guide RNA comprising a functional fragment of SEQ ID NOs:426-510, (k) a single guide RNA comprising a functional variant of SEQ ID NOs:426-510, (l) a single guide RNA comprising a chimeric non-naturally occurring crRNA linked to a tracrRNA, wherein said tracrRNA comprises a nucleotide sequence selected from the group consisting of SEQ ID NOs:341-425, a functional fragment of SEQ ID NOs:341-425, and a functional variant of SEQ ID NOs:341-425, (m) a single guide RNA comprises a chimeric non-naturally occurring crRNA linked to a tracrRNA, wherein said chimeric non-naturally occurring crRNA comprises a nucleotide sequence selected from the group consisting of SEQ ID NOs:171-255, a functional fragment of SEQ ID NOs:171-255, and a functional variant of SEQ ID NOs:171-255, (n) a guide RNA that is a duplex molecule comprising a chimeric non-naturally occurring crRNA and a tracrRNA, wherein said chimeric non-naturally occurring crRNA comprises a fragment capable of hybridizing to said target sequence, wherein said tracrRNA comprises a nucleotide sequence selected from the group consisting of: SEQ ID NOs:341-425, a functional fragment of SEQ ID NOs:341-425, and a functional variant of SEQ ID NOs:341-425, (o) a guide RNA that is a duplex molecule comprising a chimeric non-naturally occurring crRNA and a tracrRNA, wherein said chimeric non-naturally occurring crRNA comprises a nucleotide sequence selected from the group consisting of SEQ ID NOs:171-255, a functional fragment of SEQ ID NOs:171-255, and a functional variant of SEQ ID NOs:171-255, wherein said chimeric non-naturally occurring crRNA comprises a variable targeting domain capable of hybridizing to said target sequence, (p) a polynucleotide comprising both DNA and RNA, (q) a polynucleotide comprising at least one chemically-modified nucleotide, and (r) a DNA molecule capable of being transcribed into any of the RNA molecules of (i) through (q); wherein said guide polynucleotide and said Cas9 ortholog are capable of forming a complex that is capable of recognizing, binding to, and optionally nicking or cleaving a target polynucleotide sequence; and identifying at least one cell that has a modification at the target site of said cell, wherein the modification at said target site is selected from the group consisting of (i) a replacement of at least one nucleotide, (ii) a deletion of at least one nucleotide, (iii) an insertion of at least one nucleotide, (iv) modification of at least one nucleotide, and (v) any combination of (i)-(iv).

Aspect 49: The method of Aspect 48, comprising providing to said cell a plurality of Cas9 polypeptides that each recognize a different PAM sequence listed in any of Tables 4-83.

Aspect 50: The method of Aspect 48, wherein the concentration of the Cas9 ortholog is provided to said cell at a concentration of less than 100 micromolar.

Aspect 51: The method of Aspect 48, further comprising providing to said cell a polynucleotide modification template, wherein the polynucleotide modification template comprises at least one nucleotide modification as compared to the target nucleotide sequence of said cell.

Aspect 52: The method of Aspect 49, wherein said donor DNA comprises a polynucleotide of interest.

Aspect 53: The method of Aspect 52, further comprising identifying at least one cell that has the polynucleotide of interest integrated in or near the target site.

Aspect 54: The method of Aspect 52, wherein the polynucleotide of interest confers a benefit to said cell or to the organism that comprises said cell.

Aspect 55: The method of Aspect 54, wherein the polynucleotide modification or benefit is conferred to a subsequent generation of said cell or said organism that comprises said cell.

Aspect 56: The method of Aspect 54 or Aspect 55, wherein said benefit is selected from the group consisting of: improved health, improved growth, improved fertility, improved fecundity, improved environmental tolerance, improved vigor, improved disease resistance, improved disease tolerance, improved tolerance to a heterologous molecule, improved fitness, improved physical characteristic, greater mass, increased production of a biochemical molecule, decreased production of a biochemical molecule, upregulation of a gene, downregulation of a gene, upregulation of a biochemical pathway, downregulation of a biochemical pathway, stimulation of cell reproduction, and suppression of cell reproduction.

Aspect 57: The method of any one of Aspects 51-56, wherein the cell is selected from the group consisting of: a human, non-human primate, mammal, animal, archaeal, bacterial, protist, fungal, insect, yeast, non-conventional yeast, and plant cell.

Aspect 58: The method of any one of Aspects 51-56, wherein the cell is heterologous to the organism from which the Cas9 ortholog was derived.

Aspect 59: The method of Aspect 57, wherein the plant cell is selected from the group consisting of a monocot and dicot cell.

Aspect 60: The method of Aspect 57, wherein the plant cell is selected from the group consisting of: maize, rice, sorghum, rye, barley, wheat, millet, oats, sugarcane, turfgrass, switchgrass, soybean, canola, alfalfa, sunflower, cotton, tobacco, peanut, potato, tobacco, *Arabidopsis*, vegetable, and safflower cell.

Aspect 61: The method of any one of Aspects 51-56, wherein the cell is a plant cell, and wherein the modification of said target site results in the modulation of a trait of agronomic interest of a plant comprising said cell or a progeny cell thereof, selected from the group consisting of: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, improved fertility, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition; as compared to an isoline plant not comprising said target site modification or as compared to the plant prior to the modification of said target site in said plant cell.

Aspect 62: The method of Aspect 57, wherein the human cell is selected from the group consisting of: haploid cells, diploid cells, reproductive cells, neurons, muscle cells, endocrine or exocrine cells, epithelial cells, muscle cells, tumor cells, embryonic cells, hematopoietic cells, bone cells, germ cells, somatic cells, stem cells, pluripotent stem cells, induced pluripotent stem cells, progenitor cells, meiotic cells, and mitotic cells.

Aspect 63: The method of any one of Aspects 51-56, wherein the cell is an animal cell, and wherein the modification of said target site results in the modulation of a phenotype of physiological interest of an organism comprising said animal cell or a progeny cell thereof, selected from the group consisting of: improved health, improved nutritional status, reduced disease impact, disease stasis, disease reversal, improved fertility, improved vigor, improved mental capacity, improved organism growth, improved weight gain, weight loss, modulation of an endocrine system, modulation of an exocrine system, reduced tumor size, reduced tumor mass, stimulated cell growth, reduced cell growth, production of a metabolite, production of a hormone, production of an immune cell, stimulation of cell production, Aspect 64: The method of Aspect 50, wherein said animal cell is a human cell.

Aspect 65: A plant comprising a modified target site, wherein said plant originates from a plant cell comprising a modified target site produced by the method of any of Aspects 51-56.

Aspect 66: A plant comprising an edited nucleotide, wherein said plant originates from a plant cell comprising an edited nucleotide produced by the method of Aspect 49.

Aspect 67: A method of editing a plurality of polynucleotide target sequences, comprising providing to said plurality of polynucleotide target sequences a plurality of Cas9 polypeptides that each recognizes a different PAM sequence listed in any of Tables 4-83.

Aspect 68: A method of modulating target polynucleotide specificity of a Cas9 ortholog/guide polynucleotide complex as compared to its wild type activity, by changing a parameter selected from the group consisting of: (a) guide polynucleotide length, (b) guide polynucleotide composition, (c) length of PAM sequence, (d) composition of the PAM sequence, and (e) affinity of the Cas9 molecule with the target polynucleotide backbone; and assessing the target polynucleotide specificity of the complex with the changed parameter, and comparing it to the activity of a complex with wild type parameters.

Aspect 69: A method of optimizing the activity of a Cas9 molecule, comprising introducing at least one nucleotide modification to a sequence selected from the group consisting of SEQ ID NO:86-170, and identifying at least one improved characteristic as compared to that of SEQ ID NO:86-170.

Aspect 70: A method of optimizing the activity of a Cas9 molecule by subjecting a parental Cas9 molecule to at least one round of stochastic protein shuffling, and selecting a resultant molecule that has at least one characteristic not present in the parental Cas9 molecule.

Aspect 71: A method of optimizing the activity of a Cas9 molecule by subjecting a parental Cas9 molecule to at least one round of non-stochastic protein shuffling, and selecting a resultant molecule that has at least one characteristic not present in the parental Cas9 molecule.

Aspect 72: A synthetic composition comprising a Cas9 ortholog endonuclease and a heterologous polynucleotide that is capable of selective hybridization with a PAM consensus sequence of a target polynucleotide, wherein said PAM consensus sequence has a length of at least 3 nucleotides, at least 4 nucleotides, at least 5 nucleotides, at least 6 nucleotides, at least 7 nucleotides, or greater than 7 nucleotides.

Aspect 73: A method of effecting a single-strand nick or a double-strand break of a target polynucleotide, wherein said target polynucleotide comprises a PAM consensus sequence that is capable of being recognized by a guide polynucleotide, comprising introducing said guide polynucleotide and a Cas9 ortholog to said target polynucleotide, wherein said single-strand nick or double strand break occurs within said target polynucleotide.

Aspect 74: A synthetic composition comprising a Cas9 ortholog endonuclease and a heterologous polynucleotide that is capable of selective hybridization with a PAM consensus nucleotide sequence selected from the group consisting of: (a) AAA, (b) AAAA, (c) AAAAA, (d) AAAC, (e) AAAT, (f) AGA, (g) AGRG, (h) AHAC, (i) ANGG, (j) ARHHG, (k) ARNAT, (l) ATAA, (m) ATTTTT, (n) BAVMAR, (o) BGGAT, (p) CAA, (q) CAHGGDD (r) CC, (s) CCA, (t) CCH, (u) CDA, (v) CNA, (w) CNAVGAC, (x) CNG, (y) CT (z) CTA, (aa) CVG, (bb) DGGD (cc) GAAA, (dd) GG, (ee) GGAH, (ff) GGDG, (gg) GGN, (hh) GHAAA, (ii) GNA, (jj) GNAC, (kk) GNAY, (ll) GNG, (mm) GTAMY, (nn) GTGA, (oo) HAR (pp) NDGGD (qq) RNCAC, (rr) RTAA (ss) TC, (tt) TGAR, (uu) TTTTT, (vv) VNCC, (ww) VRACC, (xx) VRNTT, and (yy) VRTTT; wherein A=Adenine, C=Cytosine, G=Guanine, T=Thymine, R=A or G, Y=C or T, S=G or C, W=A or T, K=G or T, M=A or C, B=C or G or T, D=A or G or T, H=A or C or T, V=A or C or G, and N=any base; optionally wherein any nucleotide may flank said PAM consensus nucleotide sequence.

Aspect 75: A synthetic composition comprising a heterologous component and a Cas endonuclease, wherein the Cas endonuclease comprises at least one amino acid feature selected from the group consisting of: (a) Isoleucine (I) at position 13, (b) Isoleucine (I) at position 21, (c) Leucine (L) at position 71, (d) Leucine (L) at position 149, (e) Serine (S) at position 150, (f) Leucine (L) at position 444, (g) Threonine (T) at position 445, (h) Proline (P) at position 503, (i) F (Phenylalanine) at position 587, (j) A (Alanine) at position 620, (k) L (Leucine) at position 623, (l) T (Threonine) at position 624, (m) I (Isoleucine) at position 632, (n) Q (Glutamine) at position 692, (o) L (Leucine) at position 702, (p) I (Isoleucine) at position 781, (q) K (Lysine) at position 810, (r) L (Leucine) at position 908, (s) V (Valine) at position 931, (t) N/Q (Asparagine or Glutamine) at position 933, (u) K (Lysine) at position 954, (v) V (Valine) at position 955, (w) K (Lysine) at position 1000, (x) V (Valine) at position 1100, (y) Y (Tyrosine) at position 1232, and (z) I (Isoleucine) at position 1236; wherein the position numbers are determined by sequence alignment against SEQ ID NO: 1125.

Aspect 76: The synthetic composition of Aspect 1, wherein the Cas endonuclease shares at least 90% identity with a sequence selected from the group consisting of: SEQ ID NOs:86-170 and 511-1135.

Aspect 77: The synthetic composition of Aspect 1, wherein the Cas endonuclease has a total score greater than 3.14, as calculated from the amino acid position scores of Table 86A.

Aspect 78: The synthetic composition of Aspect 1, wherein the Cas endonuclease has been modified.

Aspect 79: The synthetic composition of Aspect 4, wherein the Cas endonuclease has been modified to lack endonuclease activity.

Aspect 80: The synthetic composition of Aspect 4, wherein the Cas endonuclease has been modified to nick a single strand of the target polynucleotide.

Aspect 81: The synthetic composition of Aspect 4, wherein the Cas endonuclease has been modified to further comprise a heterologous nuclease domain, a transcriptional activator domain, a transcriptional repressor domain, an epigenetic modification domain, a cleavage domain, a nuclear localization signal, a cell-penetrating domain, a deaminase domain, a base editing domain, or a translocation domain.

Aspect 82: A polynucleotide encoding the polypeptide of Aspect 1.

Aspect 83: A plasmid comprising the polynucleotide of Aspect 8.

Aspect 84: The plasmid of Aspect 9, further comprising an expression element operably linked to the polynucleotide encoding the Cas endonuclease.

Aspect 85: The plasmid of Aspect 9, further comprising a gene encoding a selectable marker or a transgene.

Aspect 86: The synthetic composition of Aspect 1, wherein the heterologous component is selected from the group consisting of: a heterologous polynucleotide, a heterologous polypeptide, a particle, a solid matrix, an antibody, Tris, EDTA, dithiothreitol (DTT), phosphate-buffered saline (PBS), sodium chloride, magnesium chloride, HEPES, glycerol, bovine serum albumin (BSA), a salt, an emulsifier, a detergent, a chelating agent, a proteinase, Proteinase K, a redox reagent, an antibody, nuclease-free water, a viscosity agent, and a Histidine tag Aspect 87: The synthetic composition of Aspect 1, wherein the Cas endonuclease is in a liquid formulation.

Aspect 88: The synthetic composition of Aspect 1, wherein the Cas endonuclease is in a lyophilized formulation.

Aspect 89: The synthetic composition of Aspect 1, wherein the Cas endonuclease is in a substantially endotoxin-free formulation.

Aspect 90: The synthetic composition of Aspect 1, wherein the Cas endonuclease is in a formulation with a pH of between 1.0 and 14.0, between 2.0 and 13.0, between 3.0 and 12.0, between 4.0 and 11.0, between 5.0 and 10.0, between 6.0 and 9.0, between 7.0 and 8.0, between 4.5 and 6.5, between 5.5 and 7.5, or between 6.5 and 7.5.

Aspect 91: The synthetic composition of Aspect 1, wherein the Cas endonuclease is stored or incubated at a temperature of at least minus 200 degrees Celsius, at least minus 150 degrees Celsius, at least minus 135 degrees Celsius, at least minus 90 degrees Celsius, at least minus 80 degrees Celsius, at least minus 20 degrees Celsius, at least 4 degrees Celsius, at least 17 degrees Celsius, at least 20 degrees Celsius, at least 25 degrees Celsius, at least 30 degrees Celsius, at least 35 degrees Celsius, at least 37 degrees Celsius, at least 39 degrees Celsius, at least 40 degrees Celsius, at least 45 degrees Celsius, at least 50 degrees Celsius, at least 55 degrees Celsius, at least 60 degrees Celsius, at least 65 degrees Celsius, at least 70 degrees Celsius, or greater than 70 degrees Celsius.

Aspect 92: The synthetic composition of Aspect 1, wherein the Cas endonuclease is attached to a solid matrix.

Aspect 93: The synthetic composition of Aspect 1, wherein the solid matrix is a particle.

Aspect 94: A kit comprising the synthetic composition of Aspect 1.

Aspect 95: The synthetic composition of Aspect 1, further comprising a guide polynucleotide.

Aspect 96: The synthetic composition of Aspect 1, further comprising a heterologous cell.

Aspect 97: The synthetic composition of Aspect 22, wherein the cell is obtained from a eukaryotic, prokaryotic, plant, or animal organism.

Aspect 98: A method of creating a double strand break in a target polynucleotide, the method comprising contacting the target polynucleotide with a guide polynucleotide that shares complementarity with the target nucleotide, and a Cas endonuclease selected from the group consisting of: (a) a polypeptide comprising at least one amino acid feature selected from the group consisting of: (i) Isoleucine (I) at position 13, (ii) Isoleucine (I) at position 21, (iii) Leucine (L) at position 71, (iv) Leucine (L) at position 149, (v) Serine (S) at position 150, (vi) Leucine (L) at position 444, (vii) Threonine (T) at position 445, (viii) Proline (P) at position 503, (ix) F (Phenylalanine) at position 587, (x) A (Alanine) at position 620, (xi) L (Leucine) at position 623, (xii) T (Threonine) at position 624, (xiii) I (Isoleucine) at position 632, (xiv) Q (Glutamine) at position 692, (xv) L (Leucine) at position 702, (xvi) I (Isoleucine) at position 781, (xvii) K (Lysine) at position 810, (xviii) L (Leucine) at position 908, (xix) V (Valine) at position 931, (xx) N/Q (Asparagine or Glutamine) at position 933, (xxi) K (Lysine) at position 954, (xxii) V (Valine) at position 955, (xxiii) K (Lysine) at position 1000, (xxiv) V (Valine) at position 1100, (xxv) Y (Tyrosine) at position 1232, and (xxvi) I (Isoleucine) at position 1236; wherein the position numbers are determined by sequence alignment against SEQ ID NO: 1125; and (b) a polypeptide comprising a domain at least 90% identical to a sequence selected from the group consisting of: SEQ ID NOs: 1136-1730; wherein the Cas endonuclease and the guide RNA form a complex that recognizes, binds to, and cleaves the target polynucleotide.

Aspect 99: The method of Aspect 24, wherein the polypeptide shares at least 90% identity with any of: SEQ ID NOs:86-170 and 511-1135.

Aspect 100: The method of Aspect 24, wherein the double strand break comprises a sticky end overhang.

Aspect 101: The method of Aspect 25, wherein the Cas endonuclease comprises a polypeptide at least 80% identical to a sequence selected from the group consisting of SEQ ID NOs: 46, 68, 63, 70, 102, 108, 119, and 131.

Aspect 102: The method of Aspect 24, wherein the double strand break comprises a blunt end.

Aspect 103: The method of Aspect 25, wherein the Cas endonuclease comprises a polypeptide at least 80% identical to a sequence selected from the group consisting of SEQ ID SEQ ID NOs: 33, 50, 56, 64, 79, 2, 3, 4, 5, 6, 8, 9, 12, 13, 16, 17, 18, 19, 27, 28, 29, 30, 32, 35, 41, 44, 47, 48, 51, 52, 60, 61, 65, 66, 67, 71, 77, 78, 80, 81, 85, 87, 94, and 97.

Aspect 104: A method of modifying a DNA target site, the method comprising: (a) contacting a polynucleotide comprising the DNA target site with a Cas endonuclease comprising a polypeptide selected from the group consisting of: (i) a polypeptide comprising at least one amino acid feature selected from the group consisting of: (1) Isoleucine (I) at position 13, (2) Isoleucine (I) at position 21, (3) Leucine (L) at position 71, (4) Leucine (L) at position 149, (5) Serine (S) at position 150, (6) Leucine (L) at position 444, (7) Threonine (T) at position 445, (8) Proline (P) at position 503, (9) F (Phenylalanine) at position 587, (10) A (Alanine) at position 620, (11) L (Leucine) at position 623, (12) T (Threonine) at position 624, (13) I (Isoleucine) at position 632, (14) Q (Glutamine) at position 692, (15) L (Leucine) at position 702, (16) I (Isoleucine) at position 781, (17) K (Lysine) at position 810, (18) L (Leucine) at position 908, (19) V (Valine) at position 931, (20) N/Q (Asparagine or Glutamine) at position 933, (21) K (Lysine) at position 954, (22) V (Valine) at position 955, (23) K (Lysine) at position 1000, (24) V (Valine) at position 1100, (25) Y (Tyrosine) at position 1232, and (26) I (Isoleucine) at position 1236; wherein the position numbers are determined by sequence alignment against SEQ ID NO: 1125; and (ii) a polypeptide comprising a domain at least 90% identical to a sequence selected from the group consisting of: SEQ ID NOs: 1136-1730; and (b) a guide polynucleotide that shares complementarity with a sequence in or near the DNA target site, wherein the Cas endonuclease and the guide RNA form a complex that recognizes, binds to, and nicks or cleaves the DNA target site; and (c) detecting at least one modification at the DNA target site.

Aspect 105: The method of Aspect 30, wherein the Case endonuclease is a polypeptide sharing at least 90% identity with any of: SEQ ID NOs:86-170 and 511-1135.

Aspect 106: The method of Aspect 30, further comprising introducing a donor DNA molecule in step (a), wherein the donor DNA molecule is integrated into the target site.

Aspect 107: The method of Aspect 30, further comprising introducing a template DNA molecule in step (a), wherein the template DNA molecule directs the repair outcome of the cleavage site.

Aspect 108: A method of editing at least one base of a target polynucleotide, comprising: (a) contacting the target polynucleotide with: (i) a deaminase, (ii) a Cas endonuclease comprising a polypeptide sharing at least 90% identity with any of: SEQ ID NOs:1136-1730, wherein the Cas endonuclease has been modified to lack nuclease activity, and (iii) a guide polynucleotide that shares complementarity with a sequence of the target polynucleotide, wherein the Cas endonuclease and the guide RNA form a complex that recognizes and binds to the target polynucleotide; and (b) detecting at least one modification at the DNA target site.

Aspect 109: The method of Aspect 34, wherein the Cas endonuclease has been modified to lack endonuclease activity.

Aspect 110: A method of modifying the genome of a cell, the method comprising:

(a) introducing into the cell a guide polynucleotide that shares complementarity with a sequence in or near a DNA target site in the cell, and a heterologous Cas endonuclease comprising a polypeptide selected from the group consisting of: (i) a polypeptide comprising at least one amino acid feature selected from the group consisting of: Isoleucine (I) at position 13, Isoleucine (I) at position 21, Leucine (L) at position 71, Leucine (L) at position 149, Serine (S) at position 150, Leucine (L) at position 444, Threonine (T) at position 445, Proline (P) at position 503, F (Phenylalanine) at position 587, A (Alanine) at position 620, L (Leucine) at position 623, T (Threonine) at position 624, I (Isoleucine) at position 632, Q (Glutamine) at position 692, L (Leucine) at position 702, I (Isoleucine) at position 781, K (Lysine) at position 810, L (Leucine) at position 908, V (Valine) at position 931, N/Q (Asparagine or Glutamine) at position 933, K (Lysine) at position 954, V (Valine) at position 955, K (Lysine) at position 1000, V (Valine) at position 1100, Y (Tyrosine) at position 1232, and I (Isoleucine) at position 1236; wherein the position numbers are determined by sequence alignment against SEQ ID NO: 1125; and (ii) a polypeptide comprising a domain at least 90% identical to a sequence selected from the group consisting of: SEQ ID NOs: 1136-1730; and wherein the Cas endonuclease and the guide RNA form a complex that recognizes, binds to, and nicks or cleaves the DNA target site; and (b) identifying at least one modification, as compared to an isoline cell not introduced to the Cas endonuclease and guide polynucleotide.

Aspect 111: The method of Aspect 35, further comprising introducing a heterologous polynucleotide in step (a), wherein the heterologous polynucleotide is a donor DNA or a template DNA.

Aspect 112: The method of Aspect 35, wherein the cell is removed from a source organism prior to step (a) and re-introduced into either the source organism or introduced into a new organism after step (a).

Aspect 113: The method of Aspect 35, wherein the cell is placed in a medium that supports growth, and a tissue or organism is regenerated from the cell Aspect 114: The method of Aspect 35, wherein the method of modifying the genome of the cell results in a benefit to an organism obtained or derived from the cell.

Aspect 115: The method of Aspect 35, wherein the cell is selected from the group consisting of: a human, non-human primate, mammal, animal, archaeal, bacterial, protist, fungal, insect, yeast, non-conventional yeast, and plant cell.

Aspect 116: The method of Aspect 40, wherein the organism is a plant.

Aspect 117: The method of Aspect 42, wherein the plant is selected from the group consisting of maize, rice, sorghum, rye, barley, wheat, millet, oats, sugarcane, turfgrass, switchgrass, soybean, canola, alfalfa, sunflower, cotton, tobacco, peanut, potato, tobacco, *Arabidopsis*, vegetable, and safflower.

Aspect 118: The method of Aspect 42, wherein the benefit is selected from the group consisting of: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, improved fertility, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition; as compared to an isoline plant not comprising said target site modification or as compared to the plant prior to the modification of said target site in said plant cell.

Aspect 119: The method of Aspect 40, wherein the organism is an animal.

Aspect 120: The method of Aspect 45, wherein the animal is a human.

Aspect 121: The method of Aspect 45, wherein the animal cell is selected from the group consisting of: haploid cells, diploid cells, reproductive cells, neurons, muscle cells, endocrine or exocrine cells, epithelial cells, muscle cells, kidney cells, ovarian cells, tumor cells, embryonic cells, hematopoietic cells, bone cells, germ cells, somatic cells, stem cells, pluripotent stem cells, induced pluripotent stem cells, progenitor cells, meiotic cells, and mitotic cells.

Aspect 122: The method of Aspect 45, wherein the modification of said target site results in the modulation of a phenotype of physiological interest of an organism comprising said animal cell or a progeny cell thereof, selected from the group consisting of: improved health, improved nutritional status, reduced disease impact, disease stasis, disease reversal, improved fertility, improved vigor, improved mental capacity, improved organism growth, improved weight gain, weight loss, modulation of an endocrine system, modulation of an exocrine system, reduced tumor size, reduced tumor mass, stimulated cell growth, reduced cell growth, production of a metabolite, production of a hormone, production of an immune cell, and stimulation of cell production.

Aspect 123: A Cas endonuclease that recognizes a PAM selected from the group consisting of: NAR (G>A)WH (A>T>C)GN (C>T>R), N (C>D)V (A>S)R (G>A)TTTN (T>V), NV (A>G>C)TTTTT, NATTTTT, NN (H>G)AAAN (G>A>Y)N, N (T>V)NAAATN, NAV (A>G>C)TCNN, NN (A>S>T)NN (W>G>C)CCN (Y>R), NNAH (T>M)ACN, NGTGANN, NARN (A>K>C)ATN, NV (G>A>C)RNTTN, NN (A>B)RN (A>G>T>C)CCN, NN (A>B)NN (T>V)CCH (A>Y), NNN (H>G)NCDAA, NN (H>G)D (A>K)GGDN (A>B), NNNNCCAG, NNNNCTAA, NNNNCVGANN (SEQ ID NO:1746), N (C>D)NNTCCN, NNNNCTA, NNNNCYAA, NAGRGNY, NNGH (W>C)AAA, NNGAAAN, NNAAAAA, NTGAR (G>A)N(A>Y>G)N (Y>R), N (C>D)H (C>W)GH (Y>A)N(A>B)AN(A>T>S), NNAAACN, NNGTAM (A>C)Y, NH (A>Y)ARNN (C>W>G)N, B (C>K)GGN(A>Y>G)N NN, N (T>C>R) AGAN (A>K>C)NN, NGGN (A>T>G>C)NNN, NGGD (A>T>G)TNN, NGGAN(T>A>C>G)NN, CGGWN (T>R>C)NN, NGGWGNN, N (B>A)GGNN (T>V)NN, NNGD (A>T>G)AY (T>C)N, N (T>V)H(T>C>A)AAAAN, NRTAANN, N (H>G)CAAH (Y>A)N(Y>R)N, NATAAN (A>T>S)N, NV (A>G>C)R (A>G)ACCN, CN (C>W>G) AV (A>S)GAC, NNRNCAC, N(A>B)GGD (W>G)D (G>W)NN, BGD (G>W)GTCN(A>K>C), NAANACN, NRTHAN(A>B)N, BHN (H>G)NGN(T>M)H(Y>A), NMRN(A>Y>G)AH(C>T>A)N, NNNCACN, NARN (T>A>S)ACN, NNNNATW, NGCNGCN, NNNCATN, NAGNGCN, NARN(T>M>G)CCN, NATCCTN, NRTAAN (T>A>S)N, N(C>T>G>A)AAD (A>G>T)CNN, NAAAGNN, NNGACNN, N(T>V)NTAAD (A>T>G)N, NNGAD (G>W)NN, NGGN(W>S)NNN, N(T>V)GGD (W>G)GNN, NGGD(A>T>G)N(T>M>G)NN, NNAAAGN, N(G>H)GGDN(T>M>G)NN, NNAGAAA, NN(T>M>G)AAAAA, N(C>D)N(C>W>G)GW(T>C)D (A>G>T)AA, NAAAAYN, NRGNNNN, NATGN (H>G) TN, NNDATTT, and NATARCN(C>T>A>G).

Aspect 124: A synthetic composition comprising a heterologous component and a Cas endonuclease, wherein the Cas endonuclease comprises at least one amino acid feature selected from the group consisting of: (a) Isoleucine (I) at position 13, (b) Isoleucine (I) at position 21, (c) Leucine (L) at position 71, (d) Leucine (L) at position 149, (e) Serine (S) at position 150, (f) Leucine (L) at position 444, (g) Threonine (T) at position 445, (h) Proline (P) at position 503, (i) F (Phenylalanine) at position 587, (j) A (Alanine) at position 620, (k) L (Leucine) at position 623, (l) T (Threonine) at position 624, (m) I (Isoleucine) at position 632, (n) Q (Glutamine) at position 692, (o) L (Leucine) at position 702, (p) I (Isoleucine) at position 781, (q) K (Lysine) at position 810, (r) L (Leucine) at position 908, (s) V (Valine) at position 931, (t) N/Q (Asparagine or Glutamine) at position 933, (u) K (Lysine) at position 954, (v) V (Valine) at position 955, (w) K (Lysine) at position 1000, (x) V (Valine) at position 1100, (y) Y (Tyrosine) at position 1232, and (z) I (Isoleucine) at position 1236; wherein the position numbers are determined by sequence alignment against SEQ ID NO: 1125.

Aspect 125: The synthetic composition of Aspect 1, wherein the Cas endonuclease shares at least 90% identity with a sequence selected from the group consisting of: SEQ ID NOs:86-170 and 511-1135.

Aspect 126: The synthetic composition of Aspect 1, wherein the Cas endonuclease comprises a domain sharing 90% or greater identity with any of SEQ ID NOs: 1136-1730.

Aspect 127: The synthetic composition of Aspect 1, wherein the Cas endonuclease is fused to a heterologous polypeptide.

Aspect 128: The synthetic composition of Aspect 4, wherein the heterologous polypeptide comprises nuclease activity.

Aspect 129: The synthetic composition of Aspect 4, wherein the heterologous polypeptide is a deaminase.

Aspect 130: The synthetic composition of Aspect 1, further comprising a guide polynucleotide with which the polypeptide forms a complex.

Aspect 131: The synthetic composition of Aspect 2, wherein the guide polynucleotide is a single guide comprising a sequence selected from the group consisting of SEQ ID NOs: 426-510.

Aspect 132: The synthetic composition of Aspect 2, wherein the guide polynucleotide comprises a tracrRNA comprising a sequence selected from the group consisting of SEQ ID NOs: 341-425.

Aspect 133: The synthetic composition of Aspect 2, wherein the guide polynucleotide comprises a crRNA comprising a sequence selected from the group consisting of SEQ ID NOs: 171-255.

Aspect 134: The synthetic composition of Aspect 2, wherein the guide polynucleotide comprises an anti-repeat sequence comprising a sequence selected from the group consisting of SEQ ID NOs: 256-340.

Aspect 135: The synthetic composition of Aspect 2, wherein the guide polynucleotide guide comprises DNA.

Aspect 136: The synthetic composition of Aspect 1 that selectively hybridizes with a PAM sequence consensus listed in Tables 4-83.

Aspect 137: A Cas endonuclease or deactivated Cas endonuclease that recognizes a PAM selected from the group consisting of: NAR (G>A)WH (A>T>C)GN (C>T>R), N (C>D)V (A>S)R (G>A)TTTN (T>V), NV (A>G>C) TTTTT, NATTTTT, NN (H>G)AAAN (G>A>Y)N, N (T>V)NAAATN, NAV (A>G>C)TCNN, NN (A>S>T)NN (W>G>C)CCN (Y>R), NNAH (T>M)ACN, NGTGANN, NARN (A>K>C)ATN, NV (G>A>C)RNTTN, NN (A>B) RN (A>G>T>C)CCN, NN (A>B)NN (T>V)CCH (A>Y), NNN (H>G)NCDAA, NN (H>G)D (A>K)GGDN (A>B), NNNNCCAG, NNNNCTAA, NNNNCVGANN (SEQ ID NO:1746), N (C>D)NNTCCN, NNNNCTA, NNNNCYAA, NAGRGNY, NNGH (W>C)AAA, NNGAAAN, NNAAAAA, NTGAR (G>A)N(A>Y>G)N (Y>R), N (C>D)H (C>W)GH (Y>A)N(A>B)AN(A>T>S), NNAAACN, NNGTAM (A>C)Y, NH (A>Y)ARNN (C>W>G)N, B (C>K)GGN(A>Y>G)N NN, N (T>C>R) AGAN (A>K>C)NN, NGGN (A>T>G>C)NNN, NGGD (A>T>G)TNN, NGGAN(T>A>C>G)NN, CGGWN (T>R>C)NN, NGGWGNN, N (B>A)GGNN (T>V)NN, NNGD (A>T>G)AY (T>C)N, N (T>V)H(T>C>A)AAAAN, NRTAANN, N (H>G)CAAH (Y>A)N(Y>R)N, NATAAN (A>T>S)N, NV (A>G>C)R (A>G)ACCN, CN (C>W>G) AV (A>S)GAC, NNRNCAC, N(A>B)GGD (W>G)D (G>W)NN, BGD (G>W)GTCN(A>K>C), NAANACN, NRTHAN(A>B)N, BHN (H>G)NGN(T>M)H(Y>A), NMRN(A>Y>G)AH(C>T>A)N, NNNCACN, NARN (T>A>S)ACN, NNNNATW, NGCNGCN, NNNCATN, NAGNGCN, NARN(T>M>G)CCN, NATCCTN, NRTAAN (T>A>S)N, N(C>T>G>A)AAD (A>G>T)CNN, NAAAGNN, NNGACNN, N(T>V)NTAAD (A>T>G)N, NNGAD (G>W)NN, NGGN(W>S)NNN, N(T>V)GGD (W>G)GNN, NGGD(A>T>G)N(T>M>G)NN, NNAAAGN, N(G>H)GGDN(T>M>G)NN, NNAGAAA, NN(T>M>G)AAAAA, N(C>D)N(C>W>G)GW(T>C)D (A>G>T)AA, NAAAAYN, NRGNNNN, NATGN (H>G) TN, NNDATTT, and NATARCN(C>T>A>G).

Aspect 138: The synthetic composition of Aspect 1 that is identified from an organism listed in Table 1.

Aspect 139: The synthetic composition of Aspect 1, selected from the group consisting of SEQ ID NOs: 86-170.

Aspect 140: The synthetic composition of Aspect 1, wherein the target cell-optimized polypeptide lacks endonuclease activity.

Aspect 141: The synthetic composition of Aspect 1, wherein the target cell-optimized polypeptide is capable of nicking a single stranded target polynucleotide.

Aspect 142: The synthetic composition of Aspect 1, wherein the target cell-optimized polypeptide is capable of cleaving a double stranded target polynucleotide.

Aspect 143: The synthetic composition of Aspect 1, further comprising a donor DNA molecule.

Aspect 144: The synthetic composition of Aspect 1, further comprising repair template DNA molecule.

Aspect 145: The synthetic composition of Aspect 1, wherein the heterologous composition is selected from the group consisting of: a heterologous polynucleotide, a heterologous polypeptide, a particle, a solid matrix, an antibody, a buffer composition, Tris, EDTA, dithiothreitol (DTT), phosphate-buffered saline (PBS), sodium chloride, magnesium chloride, HEPES, glycerol, bovine serum albumin (BSA), a salt, an emulsifier, a detergent, a chelating agent, a redox reagent, an antibody, nuclease-free water, a viscosity agent, and a Histidine tag.

Aspect 146: The synthetic composition of Aspect 19, further comprising an additional heterologous composition.

Aspect 147: The synthetic composition of Aspect 1, further comprising a cell.

Aspect 148: The synthetic composition of Aspect 21, wherein the cell is obtained or derived from an organism selected from the group consisting of: human, non-human primate, mammal, animal, archaeal, bacterial, protist, fungal, insect, yeast, non-conventional yeast, and plant.

Aspect 149: The synthetic composition of Aspect 22, wherein the plant cell is obtained or derived from maize, rice, sorghum, rye, barley, wheat, millet, oats, sugarcane, turfgrass, switchgrass, soybean, canola, alfalfa, sunflower, cotton, tobacco, peanut, potato, tobacco, *Arabidopsis*, vegetable, or safflower.

Aspect 150: The synthetic composition of Aspect 22, wherein the animal cell is selected from the group consisting of: haploid cells, diploid cells, reproductive cells, neurons, muscle cells, endocrine or exocrine cells, epithelial cells, muscle cells, tumor cells, embryonic cells, hematopoietic cells, bone cells, germ cells, somatic cells, stem cells, pluripotent stem cells, induced pluripotent stem cells, progenitor cells, meiotic cells, and mitotic cells.

Aspect 151: A polynucleotide encoding the polypeptide of Aspect 1.

Aspect 152: The polynucleotide of Aspect 25, wherein in the polynucleotide is comprised within a vector that further comprises at least one heterologous polynucleotide.

Aspect 153: A kit comprising the synthetic composition of Aspect 1 or the polynucleotide of Aspect 25.

Aspect 154: The synthetic composition of Aspect 1, wherein the polypeptide is in a liquid formulation.

Aspect 155: The synthetic composition of Aspect 1, wherein the polypeptide is in a lyophilized composition.

Aspect 156: The synthetic composition of Aspect 1, wherein the polypeptide is in a substantially endotoxin-free formulation.

Aspect 157: The synthetic composition of Aspect 1, wherein the polypeptide is in a formulation with a pH of between 1.0 and 14.0, between 2.0 and 13.0, between 3.0 and 12.0, between 4.0 and 11.0, between 5.0 and 10.0, between 6.0 and 9.0, between 7.0 and 8.0, between 4.5 and 6.5, between 5.5 and 7.5, or between 6.5 and 7.5.

Aspect 158: The synthetic composition of Aspect 1, wherein the polypeptide is stored or incubated at a temperature of at least minus 200 degrees Celsius, at least minus 150 degrees Celsius, at least minus 135 degrees Celsius, at least minus 90 degrees Celsius, at least minus 80 degrees Celsius, at least minus 20 degrees Celsius, at least 4 degrees Celsius, at least 17 degrees Celsius, at least 20 degrees Celsius, at least 25 degrees Celsius, at least 30 degrees Celsius, at least 35 degrees Celsius, at least 37 degrees Celsius, at least 39 degrees Celsius, at least 40 degrees Celsius, at least 45 degrees Celsius, at least 50 degrees Celsius, at least 55 degrees Celsius, at least 60 degrees Celsius, at least 65 degrees Celsius, at least 70 degrees Celsius, or greater than 70 degrees Celsius.

Aspect 159: The synthetic composition of Aspect 1, wherein the polypeptide is attached to a solid matrix.

Aspect 160: The synthetic composition of Aspect 33, wherein the solid matrix is a particle.

Aspect 161: A method of detecting a target polynucleotide sequence, comprising: (a) obtaining the target polynucleotide, (b) combining a Cas endonuclease, a guide polynucleotide, and said target polynucleotide in a reaction vessel, (c) incubating the components of step (b) at a temperature of at least 10 degrees Celsius for at least 1 minute, (d) sequencing the resulting polynucleotide(s) in the reaction mixture, and (e) characterizing the sequence of the target polynucleotide of step (a) that was identified by the Cas endonuclease and the guide polynucleotide; (f) wherein said guide polynucleotide comprises a polynucleotide sequence that is substantially complementary to the sequence of the target polynucleotide; wherein the Cas endonuclease comprises at least one amino acid feature selected from the group consisting of: (a) Isoleucine (I) at position 13, (b) Isoleucine (I) at position 21, (c) Leucine (L) at position 71, (d) Leucine (L) at position 149, (e) Serine (S) at position 150, (f) Leucine (L) at position 444, (g) Threonine (T) at position 445, (h) Proline (P) at position 503, (i) F (Phenylalanine) at position 587, (j) A (Alanine) at position 620, (k) L (Leucine) at position 623, (l) T (Threonine) at position 624, (m) I (Isoleucine) at position 632, (n) Q (Glutamine) at position 692, (o) L (Leucine) at position 702, (p) I (Isoleucine) at position 781, (q) K (Lysine) at position 810, (r) L (Leucine) at position 908, (s) V (Valine) at position 931, (t) N/Q (Asparagine or Glutamine) at position 933, (u) K (Lysine) at position 954, (v) V (Valine) at position 955, (w) K (Lysine) at position 1000, (x) V (Valine) at position 1100, (y) Y (Tyrosine) at position 1232, and(z) I (Isoleucine) at position 1236; wherein the position numbers are determined by sequence alignment against SEQ ID NO: 1125.

Aspect 162: A method of binding a Cas endonuclease and guide polynucleotide complex to a target polynucleotide, comprising: (a) obtaining the sequence of said target polynucleotide, (b) combining a Cas endonuclease, a guide polynucleotide, and said target polynucleotide in a reaction vessel, (c) incubating the components of step (b) at a temperature of at least 10 degrees Celsius for at least 1 minute; wherein said guide polynucleotide comprises a polynucleotide sequence that is substantially complementary to the target polynucleotide sequence of the target polynucleotide; further comprising detecting the Cas endonuclease and guide polynucleotide complex bound to the target polynucleotide; and wherein the Cas endonuclease comprises at least one amino acid feature selected from the group consisting of: (a) Isoleucine (I) at position 13, (b) Isoleucine (I) at position 21, (c) Leucine (L) at position 71, (d) Leucine (L) at position 149, (e) Serine (S) at position 150, (f) Leucine (L) at position 444, (g) Threonine (T) at position 445, (h) Proline (P) at position 503, (i) F (Phenylalanine) at position 587, (j) A (Alanine) at position 620, (k) L (Leucine) at position 623, (l) T (Threonine) at position 624, (m) I (Isoleucine) at position 632, (n) Q (Glutamine) at position 692, (o) L (Leucine) at position 702, (p) I (Isoleucine) at position 781, (q) K (Lysine) at position 810, (r) L (Leucine) at position 908, (s) V (Valine) at position 931, (t) N/Q (Asparagine or Glutamine) at position 933, (u) K (Lysine) at position 954, (v) V (Valine) at position 955, (w) K (Lysine) at position 1000, (x) V (Valine) at position 1100, (y) Y (Tyrosine) at position 1232, and(z) I (Isoleucine) at position 1236; wherein the position numbers are determined by sequence alignment against SEQ ID NO: 1125.

Aspect 163: A method of creating a double strand break in a target polynucleotide, comprising: (d) obtaining the sequence of said target polynucleotide, (e) combining a Cas endonuclease polypeptide, a guide polynucleotide, and said target polynucleotide in a reaction vessel, (f) incubating the components of step (b) at a temperature of at least 10 degrees Celsius for at least 1 minute; wherein said guide polynucleotide comprises a polynucleotide sequence that is substantially complementary to the target polynucleotide sequence of the target polynucleotide; further comprising detecting the Cas endonuclease and guide polynucleotide complex bound to the target polynucleotide; and wherein the Cas endonuclease comprises at least one amino acid feature selected from the group consisting of: (a) Isoleucine (I) at position 13, (b) Isoleucine (I) at position 21, (c) Leucine (L)

at position 71, (d) Leucine (L) at position 149, (e) Serine (S) at position 150, (f) Leucine (L) at position 444, (g) Threonine (T) at position 445, (h) Proline (P) at position 503, (i) F (Phenylalanine) at position 587, (j) A (Alanine) at position 620, (k) L (Leucine) at position 623, (l) T (Threonine) at position 624, (m) I (Isoleucine) at position 632, (n) Q (Glutamine) at position 692, (o) L (Leucine) at position 702, (p) I (Isoleucine) at position 781, (q) K (Lysine) at position 810, (r) L (Leucine) at position 908, (s) V (Valine) at position 931, (t) N/Q (Asparagine or Glutamine) at position 933, (u) K (Lysine) at position 954, (v) V (Valine) at position 955, (w) K (Lysine) at position 1000, (x) V (Valine) at position 1100, (y) Y (Tyrosine) at position 1232, and(z) I (Isoleucine) at position 1236; wherein the position numbers are determined by sequence alignment against SEQ ID NO: 1125.

Aspect 164: The method of Aspect 36 or Aspect 37, further comprising at least one additional target site.

Aspect 165: A method for editing the genome of a cell, the method comprising providing to the cell: (a) at least one Cas endonuclease comprises at least one amino acid feature selected from the group consisting of: (i) Isoleucine (I) at position 13, (ii) Isoleucine (I) at position 21, (iii) Leucine (L) at position 71, (iv) Leucine (L) at position 149, (v) Serine (S) at position 150, (vi) Leucine (L) at position 444, (vii) Threonine (T) at position 445, (viii) Proline (P) at position 503, (ix) F (Phenylalanine) at position 587, (x) A (Alanine) at position 620, (xi) L (Leucine) at position 623, (xii) T (Threonine) at position 624, (xiii) I (Isoleucine) at position 632, (xiv) Q (Glutamine) at position 692, (xv) L (Leucine) at position 702, (xvi) I (Isoleucine) at position 781, (xvii) K (Lysine) at position 810, (xviii) L (Leucine) at position 908, (xix) V (Valine) at position 931, (xx) N/Q (Asparagine or Glutamine) at position 933, (xxi) K (Lysine) at position 954, (xxii) V (Valine) at position 955, (xxiii) K (Lysine) at position 1000, (xxiv) V (Valine) at position 1100, (xxv) Y (Tyrosine) at position 1232, and(xxvi) I (Isoleucine) at position 1236; wherein the position numbers are determined by sequence alignment against SEQ ID NO: 1125; and (b) a guide polynucleotide with which the Cas endonuclease forms a complex; wherein the complex is capable of recognizing, binding to, and optionally nicking or cleaving a target polynucleotide sequence; and identifying at least one cell that has a modification in a genomic DNA sequence of the cell, wherein the modification is selected from the group consisting of: an insertion, a deletion, a substitution, and the addition or association of an atom or molecule to an existing nucleotide.

Aspect 166: A method of modulating the expression of a gene in a cell, the method comprising providing to the cell: (a) at least one Cas endonuclease comprises at least one amino acid feature selected from the group consisting of: (i) Isoleucine (I) at position 13, (ii) Isoleucine (I) at position 21, (iii) Leucine (L) at position 71, (iv) Leucine (L) at position 149, (v) Serine (S) at position 150, (vi) Leucine (L) at position 444, (vii) Threonine (T) at position 445, (viii) Proline (P) at position 503, (ix) F (Phenylalanine) at position 587, (x) A (Alanine) at position 620, (xi) L (Leucine) at position 623, (xii) T (Threonine) at position 624, (xiii) I (Isoleucine) at position 632, (xiv) Q (Glutamine) at position 692, (xv) L (Leucine) at position 702, (xvi) I (Isoleucine) at position 781, (xvii) K (Lysine) at position 810, (xviii) L (Leucine) at position 908, (xix) V (Valine) at position 931, (xx) N/Q (Asparagine or Glutamine) at position 933, (xxi) K (Lysine) at position 954, (xxii) V (Valine) at position 955, (xxiii) K (Lysine) at position 1000, (xxiv) V (Valine) at position 1100, (xxv) Y (Tyrosine) at position 1232, and (xxvi) I (Isoleucine) at position 1236; wherein the position numbers are determined by sequence alignment against SEQ ID NO: 1125, and(b) a guide polynucleotide with which the Cas endonuclease forms a complex; wherein the complex is capable of recognizing, binding to, and optionally nicking or cleaving a target polynucleotide sequence in the cell; and identifying at least one cell that has a modulated gene expression as compared to a cell that did not have the Cas endonuclease introduced.

Aspect 167: The method of Aspect 39 or Aspect 40, further comprising providing to the cell a donor DNA molecule.

Aspect 168: The method of Aspect 39 or Aspect 40, further comprising providing to the cell a template DNA molecule.

Aspect 169: The method of Aspect 39 or Aspect 40, wherein the method confers a benefit to the cell or to an organism that comprises the cell.

Aspect 170: The method of Aspect 41, wherein the benefit is selected from the group consisting of: improved health, improved growth, improved fertility, improved fecundity, improved environmental tolerance, improved vigor, improved disease resistance, improved disease tolerance, improved tolerance to a heterologous molecule, improved fitness, improved physical characteristic, greater mass, increased production of a biochemical molecule, decreased production of a biochemical molecule, upregulation of a gene, downregulation of a gene, upregulation of a biochemical pathway, downregulation of a biochemical pathway, stimulation of cell reproduction, and suppression of cell reproduction.

Aspect 171: The method of Aspect 39 or Aspect 40, wherein the cell is heterologous to the organism from which the Cas endonuclease was derived, and is selected from the group consisting of: a human, non-human primate, mammal, animal, archaeal, bacterial, protist, fungal, insect, yeast, non-conventional yeast, and plant cell.

Aspect 172: The method of Aspect 45, wherein the plant cell is obtained or derived from maize, rice, sorghum, rye, barley, wheat, millet, oats, sugarcane, turfgrass, switchgrass, soybean, canola, alfalfa, sunflower, cotton, tobacco, peanut, potato, tobacco, *Arabidopsis*, vegetable, or safflower.

Aspect 173: The method of Aspect 45, wherein the cell is a plant cell, and the benefit is the modulation of a trait of agronomic interest of a plant comprising said cell or a progeny cell thereof, selected from the group consisting of: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, improved fertility, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition; as compared to an isoline plant not comprising said target site modification or as compared to the plant prior to the modification of said target site in said plant cell.

Aspect 174: The method of Aspect 45, wherein the animal cell is selected from the group consisting of: haploid cells, diploid cells, reproductive cells, neurons, muscle cells, endocrine or exocrine cells, epithelial cells, muscle cells, tumor cells, embryonic cells, hematopoietic cells, bone cells, germ cells, somatic cells, stem cells, pluripotent stem cells, induced pluripotent stem cells, progenitor cells, meiotic cells, and mitotic cells.

Aspect 175: The method of Aspect 45, wherein the cell is an animal cell, and the benefit is the modulation of a phenotype of physiological interest of an organism comprising the animal cell, or a progeny cell thereof, selected from the group consisting of: improved health, improved nutritional status, reduced disease impact, disease stasis, disease reversal, improved fertility, improved vigor, improved mental capacity, improved organism growth, improved weight gain, weight loss, modulation of an endocrine system, modulation of an exocrine system, reduced tumor size, reduced tumor mass, stimulated cell growth, reduced cell growth, production of a metabolite, production of a hormone, production of an immune cell, and stimulation of cell production.

Aspect 176: A method of editing at least one base of a target polynucleotide, comprising: (a) contacting the target polynucleotide with: i. a deaminase, ii. a Cas endonuclease capable of selective hybridization with a PAM sequence consensus listed in Tables 4-83, wherein the Cas endonuclease has been modified to lack nuclease activity, and iii. a guide polynucleotide that shares complementarity with a sequence of the target polynucleotide, wherein the Cas endonuclease and the guide RNA form a complex that recognizes and binds to the target polynucleotide; and(b) detecting at least one modification at the DNA target site.

Aspect 177: A method of editing a plurality of bases of a target polynucleotide, comprising: (a) contacting the target polynucleotide with: i. at least one deaminase, ii. a plurality of Cas endonucleases, each capable of selective hybridization with a PAM sequence consensus listed in Tables 4-83, wherein the Cas endonucleases have been modified to lack nuclease activity, and iii. a guide polynucleotide that shares complementarity with a sequence of the target polynucleotide, wherein the Cas endonuclease and the guide RNA form a complex that recognizes and binds to the target polynucleotide; and(b) detecting at least one modification at the DNA target site.

Aspect 178: A method of optimizing the activity of a Cas molecule comprising introducing at least one nucleotide modification to a sequence that comprises at least one amino acid feature selected from the group consisting of: (a) Isoleucine (I) at position 13, (b) Isoleucine (I) at position 21, (c) Leucine (L) at position 71, (d) Leucine (L) at position 149, (e) Serine (S) at position 150, (f) Leucine (L) at position 444, (g) Threonine (T) at position 445, (h) Proline (P) at position 503, (i) F (Phenylalanine) at position 587, (j) A (Alanine) at position 620, (k) L (Leucine) at position 623, (l) T (Threonine) at position 624, (m) I (Isoleucine) at position 632, (n) Q (Glutamine) at position 692, (o) L (Leucine) at position 702, (p) I (Isoleucine) at position 781, (q) K (Lysine) at position 810, (r) L (Leucine) at position 908, (s) V (Valine) at position 931, (t) N/Q (Asparagine or Glutamine) at position 933, (u) K (Lysine) at position 954, (v) V (Valine) at position 955, (w) K (Lysine) at position 1000, (x) V (Valine) at position 1100, (y) Y (Tyrosine) at position 1232, and(z) I (Isoleucine) at position 1236; wherein the position numbers are determined by sequence alignment against SEQ ID NO: 1125; and identifying at least one improved characteristic as compared to the molecule prior to nucleotide modification.

Aspect 179: A method of optimizing the activity of a Cas9 molecule by subjecting a parental Cas9 molecule to at least one round of stochastic protein shuffling, and selecting a resultant molecule that has at least one characteristic not present in the parental Cas9 molecule; wherein the parental Cas9 molecule comprises at least one amino acid feature selected from the group consisting of: (a) Isoleucine (I) at position 13, (b) Isoleucine (I) at position 21, (c) Leucine (L) at position 71, (d) Leucine (L) at position 149, (e) Serine (S) at position 150, (f) Leucine (L) at position 444, (g) Threonine (T) at position 445, (h) Proline (P) at position 503, (i) F (Phenylalanine) at position 587, (j) A (Alanine) at position 620, (k) L (Leucine) at position 623, (1) T (Threonine) at position 624, (m) I (Isoleucine) at position 632, (n) Q (Glutamine) at position 692, (o) L (Leucine) at position 702, (p) I (Isoleucine) at position 781, (q) K (Lysine) at position 810, (r) L (Leucine) at position 908, (s) V (Valine) at position 931, (t) N/Q (Asparagine or Glutamine) at position 933, (u) K (Lysine) at position 954, (v) V (Valine) at position 955, (w) K (Lysine) at position 1000, (x) V (Valine) at position 1100, (y) Y (Tyrosine) at position 1232, and(z) I (Isoleucine) at position 1236; wherein the position numbers are determined by sequence alignment against SEQ ID NO: 1125.

Aspect 180: A method of optimizing the activity of a Cas9 molecule by subjecting a parental Cas9 molecule to at least one round of non-stochastic protein shuffling, and selecting a resultant molecule that has at least one characteristic not present in the parental Cas9 molecule; wherein the parental Cas9 molecule comprises a motif selected from the group consisting of comprises at least one amino acid feature selected from the group consisting of: (a) Isoleucine (I) at position 13, (b) Isoleucine (I) at position 21, (c) Leucine (L) at position 71, (d) Leucine (L) at position 149, (e) Serine (S) at position 150, (f) Leucine (L) at position 444, (g) Threonine (T) at position 445, (h) Proline (P) at position 503, (i) F (Phenylalanine) at position 587, (j) A (Alanine) at position 620, (k) L (Leucine) at position 623, (l) T (Threonine) at position 624, (m) I (Isoleucine) at position 632, (n) Q (Glutamine) at position 692, (o) L (Leucine) at position 702, (p) I (Isoleucine) at position 781, (q) K (Lysine) at position 810, (r) L (Leucine) at position 908, (s) V (Valine) at position 931, (t) N/Q (Asparagine or Glutamine) at position 933, (u) K (Lysine) at position 954, (v) V (Valine) at position 955, (w) K (Lysine) at position 1000, (x) V (Valine) at position 1100, (y) Y (Tyrosine) at position 1232, and(z) I (Isoleucine) at position 1236; wherein the position numbers are determined by sequence alignment against SEQ ID NO: 1125.

While the invention has been particularly shown and described with reference to a preferred embodiment and various alternate embodiments, it will be understood by persons skilled in the relevant art that various changes in form and details can be made therein without departing from the spirit and scope of the invention. For instance, while the particular examples below may illustrate the methods and embodiments described herein using a specific plant, the principles in these examples may be applied to any plant. Therefore, it will be appreciated that the scope of this invention is encompassed by the embodiments of the inventions recited herein and in the specification rather than the specific examples that are exemplified below. All cited patents and publications referred to in this application are herein incorporated by reference in their entirety, for all purposes, to the same extent as if each were individually and specifically incorporated by reference.

EXAMPLES

The following are examples of specific embodiments of some aspects of the invention. The examples are offered for illustrative purposes only, and are not intended to limit the scope of the invention in any way. Efforts have been made to ensure accuracy with respect to numbers used (e.g., amounts, temperatures, etc.), but some experimental error and deviation should, of course, be allowed for.

The meaning of abbreviations is as follows: "sec" means second(s), "min" means minute(s), "h" means hour(s), "d" means day(s), "μL" or "uL" or "μl" or "ul" means microliter(s), "mL" means milliliter(s), "L" means liter(s), "μM" means micromolar, "mM" means millimolar, "M" means molar, "mmol" means millimole(s), "μmole" or "umole" mean micromole(s), "g" means gram(s), "μg" or "ug" means microgram(s), "ng" means nanogram(s), "U" means unit(s), "bp" means base pair(s) and "kB" means kilobase(s).

Example 1: Identification of Cas9 Orthologs and their Guide RNAs

In this example, methods for identifying Cas9 proteins and their associated guide RNA(s) from Type II CRISPR (Clustered Regularly Interspaced Short Palindromic Repeats)-Cas (CRISPR associated) loci are described.

Cas9 Identification

Type II Cas9 endonucleases were identified by first searching for the presence of clustered regularly interspaced short palindromic repeats (CRISPRs) indicative of the CRISPR-Cas nucleic acid based adaptive immune systems of bacteria and archaea (Bhaya, D. et al. (2011) *Annu. Rev. Genet.* 45: 273-97) in public sequence collections using PILER-CR (Edgar, R. C. (2007) *BMC Bioinformatics.* 8: 18). Following the identification of CRISPR arrays, the DNA regions surrounding the CRISPR array (about 20 kb 5' and 3' of the CRISPR array) were examined for the presence of open-reading frames (ORFs) encoding proteins greater than 750 amino acids. Next, to identify CRISPR associated genes homologous to Cas9, multiple sequence alignment of protein sequences from a diverse collection of Cas9 endonucleases was performed using MUSCLE (Edgar, R. C. (2004) *Nucleic Acids Res.* 32: 1792-97) and used to build profile hidden Markov models (HMMs) for Cas9 sub-families as described previously (Fonfara, I. et al. (2014) *Nucleic Acids Res.* 42: 2577-2590) using HMMER (Eddy, S. R. (1998) *Bioinformatics.* 14: 755-63 and Eddy, S. R. (2011) *PLoS Comput. Biol.* 7: e1002195). The resulting HMMs were then utilized to search protein sequences translated from the CRISPR associated ORFs for the presence of cas genes with homology to Cas9. Only proteins comprising the key HNH and RuvC nucleolytic domains and catalytic residues defining a Type II Cas9 protein (Nishimasu, H. et al. (2014) *Cell.* 156: 935-49) were selected. Through comparative analyses, Cas9 proteins were parsed into distinct families and representative members of each family used to construct a phylogenetic tree with MEGA7 (Kumar, S. et al. (2016) *Mol. Biol. Evol.* 33: 1870-74) utilizing the Neighbor-Joining (Saitou, N. et al. (1987) *Mol. Biol. Evol.* 4: 406-25) and Poisson correction (Zuckerkandl, E. et al. (1965) *Evol. genes proteins.* 97: 97-166) methods to compute the evolutionary history.

The resulting phylogenetic tree, representing 675 Type II Cas9 sequences (SEQ ID NOs: 86-170 and 511-1135), was divided into 12 clades based on phylogenetic distance. Proteins were then selected to capture the diversity presented by Cas9 orthologs (FIG. 1). Clades giving rise to previously characterized Cas9 proteins with positive attributes (e.g. activity in eukaryotic cells or interesting protospacer adjacent motif (PAM) recognition) were mined at a rate of approximately 20% while all others were surveyed at a rate of approximately 10%. In total, 85 Cas9 proteins were selected for further characterization (Table 1).

Next, structural analyses were performed to further confirm the candidate proteins as Cas9 orthologs. First, whole sequences were aligned using Ssearch36 (Smith, T. F. and Waterman, M. S. (1981) *J. Mol. Biol.* 147: 195-97 and Pearson, W. R. (1991) *Genomics* 11: 635-50) with known Cas9 structures from the Protein Data Bank (PDB, The Protein Data Bank H. M. Berman, J. Westbrook, Z. Feng, G. Gilliland, T. N. Bhat, H. Weissig, I. N. Shindyalov, P. E. Bourne (2000) *Nucleic Acids Research,* 28: 235-242). Then, the best matching structure was utilized as a template to assign functional domain boundaries according to structural domains defined in the known Cas9s. The resulting structural alignment produced six distinct groups, based on the similarity to modelling templates with largest variation at REC subdomain.

REC Group I Cas9 orthologs (SEQ ID NOs: 93, 97, 98, 99, 100, 101, 102, 103, 104, 105, 106, 107, 108, 109, 110, 111, 112, 113, 114, 115, 116, 117, 118, 136, 137, 138, 139, 140, 141, 143, 144, 145, 146, 148, 158, 160, 161, 162, 142, 168, and 169) were aligned against the *Staphylococcus aureus* Cas9 structure PDB ID 5CZZ_A ("Crystal structure of *Staphylococcus aureus* Cas9", Nishimasu, H., Cong, L., Yan, W. X., Ran, F. A., Zetsche, B., Li, Y., Kurabayashi, A., Ishitani, R., Zhang, F., Nureki, O., (2015) *Cell* 162: 1113-1126). The consensus sequence is shown in FIG. 4, with conserved residues depicted in bold, underlined text (X).

REC Group II (represented by a single Cas9 ortholog, SEQ ID NO: 96) aligned with PDB:5czz in full length, but comprised a novel insertion of approximately 312 amino acid residues prior to the RuvCIII domain signature helix. This was a unique feature of this group.

REC Group III Cas9 orthologs (86, 87, 88, 89, 90, 91, 92, 94, 119, 120, 121, 122, 123, 124, 125, 126, 127, 128, 129, 130, 131, 132, 147, 149, 150, 151, 152, 153, 154, 155, 156, 157, 159, 163, 164, 165, 166, 167, and 170) were aligned against the *Streptococcus pyogenes* serotype M1 structure PDB ID 4UN3_B ("Structural Basis of Pam-Dependent Target DNA Recognition by the Cas9 Endonuclease", Anders, C., Niewoehner, O., Duerst, A., Jinek, M., (2014) *Nature* 513: 569-73). The consensus sequence is shown in FIG. 5, with conserved residues depicted in bold, underlined text (X).

REC Group IV Cas9 orthologs (SEQ ID NOs: 133 and 134) were aligned against the *Actinomyces naeslundii* structure PDB ID 4OGE_A ("Structures of Cas9 endonucleases reveal RNA-mediated conformational activation", Jinek, M., Jiang, F., Taylor, D. W., Sternberg, S. H., Kaya, E., Ma, E., Anders, C., Hauer, M., Zhou, K., Lin, S., Kaplan, M., Iavarone, A. T., Charpentier, E., Nogales, E., Doudna, J. A., (2014) *Science* 343: 1247997). The consensus sequence is shown in FIG. 6, with conserved residues depicted in bold, underlined text (X). The consensus sequence for Group IV featured multiple tryptophan residues, which was a unique feature among the Cas9s examined.

SEQ ID NOs: 95, 96, and 135 aligned with a known structural template only partially. Therefore, HHsearch (Soding, J. (2005) *Bioinformatics.* 21: 951-60), a profile-profile search program, was used to extend candidate-template alignment. SEQ ID NO: 95 (REC Group V) aligned with PDB:4oge fully, and SEQ ID NO: 135 (REC Group VI) aligned with *Francisella novicida* Cas9 (PDB:5b2o) from beginning to end.

In all, sequences belonged to the Cas9 family and comprise all of the major functional domains in this order: RuvCI, bridge helix, REC, RuvCII, HNH, RuvCIII, WED, and PI (Table 2A). Like other known Cas9 proteins, there was sequence length variation, ranging from ~1,000 to ~1,600 residues. Table 2B lists the SEQ IDs for each domain of each Cas9 ortholog.

Compared to the phylogenic analysis, the template-based approach clustered sequences into groups coincident with their length: for example, Group I of ~1,100 aa and Group III of ~1,350 aa. The major sequence length variation occurred at the REC domain responsible for nucleotide-chain binding. Consistently, REC domain was also the least conserved sequence segment in Cas9 protein superfamily. Clade I-X and Group I-II-III-V were very similar to one another, forming a family, while Clade XI corresponding to Group IV and Clade XII corresponding to Group VI showed more divergence.

Guide RNA Identification

Next, the small RNA(s) capable of complexing with and guiding the Cas9 orthologs described herein (Table 1) to recognize a DNA target sequence adjacent to an appropriate PAM (protospacer adjacent motif) were predicted. First, the trans-activating RNA (tracrRNA) essential for CRISPR RNA (crRNA) maturation (Deltcheva, E. et al. (2011) *Nature*. 471: 602-7) and Cas9 directed target site cleavage in Type II systems (Jinek, M. et al. (2012) *Science*. 337: 816-21 and Karvelis, T. et al. (2013) *RNA Biol*. 10: 20-19) was identified by searching for a region in the vicinity of the cas9 gene, the anti-repeat, which may base-pair with the CRISPR repeat and was distinct from the CRISPR array(s). Once identified, the possible transcriptional directions of the putative tracrRNA(s) for each new system were established by examining the secondary structures using UNAfold (Markham, N. R. et al. (2008) *Methods Mol. Biol*. 453: 3-31) and possible termination signals present in RNA versions corresponding to the sense and anti-sense transcription scenarios surrounding the anti-repeat as described in Karvelis, T. et al. (2015) *Genome Biology*. 16:253. Once the tracrRNA was predicted, the transcriptional direction of the crRNA could also be deduced (since the tracrRNA must hybridize to the crRNA with 5' to 3' directionality). Following guide RNA predictions, single guide RNAs (sgRNAs) representing a non-natural artificial linkage of the crRNA and tracrRNA (Jinek, M. et al. (2012) *Science*. 337: 816-21), were designed and are listed in Table 3.

All sgRNA molecules used in this study were synthesized by in vitro transcription using TranscriptAid T7 High Yield Transcription Kit (Thermo Fisher Scientific) or transcribed directly in the in vitro translation (IVT) reaction. Templates for sgRNA transcription were generated by PCR amplifying synthesized fragments (IDT and Genscript).

Example 2: Determination of the Protospacer Adjacent Motif Requirement and Target Cleavage Pattern for Cas9 Orthologs In this example, methods for the rapid characterization of the protospacer adjacent motif (PAM) requirement and the position and type (e.g. blunt, 5' overhang, or 3' overhang) of double-stranded DNA target cleavage for orthologous Cas9 proteins are described.

To determine the PAM sequences that support DNA target recognition and cleavage, Cas9 protein was produced using either a continuous exchange 1-Step Human Coupled IVT Kit (Thermo Fisher Scientific) or a PUREexpress bacterial IVT kit (New England Biolabs), following the manufacturer's recommended protocol. This was accomplished by first generating a plasmid DNA encoding the Cas9 othologo. For the Human Coupled kit, genes were human codon optimized and synthesized (Genescript, Inc. and Twist Bioscience) into pT7-N-His-GST (Thermo Fisher Scientific). For the bacterial IVT kit, genes were *E. coli* codon optimized, synthesized (Genescript, Inc. and Twist Bioscience), and cloned into the pET28a (New England Biolabs) expression cassette.

Following in vitro expression, Cas9 ribonucleoprotein (RNP) complexes were generated. This was carried-out by first clearing the reactions of debris centrifugation at 14,000 g for 30 min at 4° C. Next, 20 µl of supernatant containing the soluble Cas9 protein was immediately combined with 2 µg of the T7 transcribed guide RNA(s) in the presence of 1 µl (40 U) of RiboLock RNase Inhibitor (Thermo Fisher Scientific, USA) and incubated for 15 min. at room temperature. In some instances, the sgRNA was transcribed directly in the IVT reaction by supplying a DNA template containing a T7 promoter and sequence encoding the respective sgRNA. In this case, Cas9-guide RNA ribonucleoprotein (RNP) complexes were not processed any further but used directly in the next step.

Next, digestion of a randomized PAM library was then performed by gently combining 10 µl of the Cas9-guide RNA lysate mixture with 90 µl of reaction buffer (10 mM Tris-HCl, pH 7.5 at 37° C., 100 mM NaCl and 1 mM DTT, 10 mM MgCl2) and 1 µg of the 7 bp randomized PAM library from Karvelis et al. 2015 containing a T1 target sequence. After 1 h at 37° C., reactions were subject to DNA end-repaired by incubating them with 1 µl (5 U) of T4 DNA polymerase and 1 µl of 10 mM dNTP mix (Thermo Fisher Scientific, USA) for 20 min at 11° C. The reaction was then inactivated by heating it to 75° C. for 10 min. To efficiently capture free DNA ends by adapter ligation, a 3'-dA overhang was added by incubating the reaction mixture with 1 µl (5 U) of DreamTaq polymerase (Thermo Fisher Scientific, EP0701) for 30 min. at 72° C. Excess RNA was then removed from the reaction by incubating 1 µl of RNase A/T1 (Thermo Fisher Scientific, USA) for 30 min at 37° C. The resulting DNA was then purified using a Monarch PCR & DNA Cleanup purification column (New England Biolabs, USA).

Following digestion and end repair, the PAM sequences supporting cleavage were then captured by adapter ligation. This was accomplished by first preparing an adapter with a 3'-dT overhang by annealing A1 (5'-CGGCATTCCTGCT-GAACCGCTCTTCCGATCT-3' (SEQ ID NO:1731)) and phosphorylated A2 (5'-GATCG-GAAGAGCGGTTCAGCAGGAATGCCG-3' (SEQ ID NO:1732) oligonucleotides by heating an equimolar mixture of the two for 5 min at 95° C. and slowly cooling (~0.1° C./s) to room temperature in Annealing (A) buffer (10 mM Tris-HCl, pH 7.5 at 37° C., 50 mM NaCl). The adapter was then ligated to the end repaired 3'-dA overhanging cleavage products by combining 100 ng of it and the adapter with 5 U of T4 Ligase (Thermo Fisher Scientific, USA) in 25 µl of ligation buffer (40 mM Tris-HCl, pH 7.8 at 25° C., 10 mM MgCl2, 10 mM DTT, 0.5 mM ATP, 5% (w/v) PEG 4000) and allowing the reaction to proceed for 1 h at room temperature.

Next, the cleaved products containing the PAM sequence were enriched using R0 (5'-GCCAGGGTTTTCCCAGT-CACGA-3' (SEQ ID NO:1733)) and the A1 oligonucleotide specific to the 7 bp PAM library and adapter, respectively. PCR was performed with Phusion High-Fidelity PCR Master Mix with high fidelity (HF) Buffer (Thermo Fisher Scientific, USA) or Q5 DNA polymerase (New England Biolabs, USA) using 10 µl of the ligation reaction as template. A two-step amplification protocol (98° C.—30 s initial denaturation, 98° C.—15 s, 72° C.—30 s denaturation, annealing and synthesis for 15 cycles and 72° C.—5 min for final extension) was used. For the samples assembled in the absence of a Cas9, PCR was performed using the R0 and the C0 primer (5'-GAAAT-TCTAAACGCTAAAGAGGAAGAGG-3' (SEQ ID NO:1734)) pair with C0 being complementary to protospacer sequence. Next, the amplification products (148 bp and 145 bp for A1/R0 and C0/R0 primer pairs, respectively) were purified using a Monarch PCR & DNA Cleanup purification column (New England Biolabs, USA).

Next, the sequences and indexes required for Illumina deep sequencing were incorporated onto the ends of the Cas9 cleaved DNA fragments and the resulting products deep sequenced. This was accomplished through two rounds of PCR using Phusion High-Fidelity PCR Master Mix in HF buffer (New England Biolabs, USA) per the manufacturer's instruction. The primary PCR was assembled using 20 ng of Cas9 cleaved adapter ligated PAM-sided template and allowed to proceed for 10 cycles. The reaction uses a forward primer, F1 (5'-CTACACTCTTTCCCTA-CACGACGCTCTTCCGATCTAAGGCGGCAT-TCCTGCTGAAC-3' (SEQ ID NO:1735)) that can hybridize to the adapter and a reverse primer, R1 (5'-CAAGCAGAA-GACGGCATACGAGCTCTTCCGATCTCGGCGACGT-TGGGTC-3' (SEQ ID NO:1736)), that binds to a site 3' of the region of PAM randomization. In addition to hybridizing to the adapter ligated PAM fragment, the primers also contain Illumina sequences extending off their 5' ends. For the forward primer, the extra sequence includes a portion of the sequence required for bridge amplification (5'-CTA-CACTCTTTCCCTACACGACGCTCTTCCGATCT-3' (SEQ ID NO:1737)) followed by an interchangeable unique index sequence (5'-AAGG-3') that permits multiple amplicons to be deconvoluted if sequenced simultaneously. For the reverse primer, the additional sequence is comprised only of that required for bridge amplification at the 3' end of the amplicon (5'-CAAGCAGAAGACGGCAT-ACGAGCTCTTCCGATCT-3' (SEQ ID NO:1738)). The following PCR cycling conditions were used: 95° C.—30 s initial denaturation, 95° C.—10 s, 60° C.—15 s, 72° C.—5 s denaturation, annealing and synthesis for 10 cycles and 72° C.—5 min for final extension. Following primary PCR, a second round of PCR amplification was performed using 2 μl (in total volume of 50 μl) of the first round PCR as template. The forward primer, F2 (5'-AATGA-TACGGCGACCACCGAGATCTACACTCTTTCCCTA-CACG-3' (SEQ ID NO:1739)), used in the secondary PCR hybridizes to the 5' region of F1 further extending the sequences required for Illumina deep sequencing. The reverse primer, R2 (5'-CAAGCAGAAGACGGCATA-3' (SEQ ID NO:1740)), used in the secondary PCR simply binds to the 3' end of the primary PCR amplicon. The following PCR cycling conditions were used: 95° C.—30 s initial denaturation, 95° C.—10 s, 58° C.—15 s, 72° C.—5 s denaturation, annealing and synthesis for 10 cycles and 72° C.—5 min for final extension. Following library creation, amplifications were purified with a QIAquick PCR Purification Kit (Qiagen, USA) per the manufacturer's instruction and combined into a single sample in an equimolar concentration. Next, the libraries were single-read deep sequenced on a MiSeq Personal Sequencer (Illumina, USA) with a 25% (v/v) spike of PhiX control v3 (Illumina, USA) and sequences post-processed and deconvoluted per the manufacture's instruction. Note the original PAM library was also sequenced as a control to account for inherent bias that would affect downstream PAM analyses. This is carried out as described above except the forward primer in the primary PCR, C1 (5'-CTACACTCTTTCCCTACACGACGC-TCTTCCGATCTGGAATAAACGCTAAAGAGGAAG AGG-3' (SEQ ID NO:1741)), is used instead of F1 as it hybridizes directly to the protospacer region in the uncut PAM library.

Next, PAM recognition was evaluated. This was accomplished by first generating a collection of sequences representing all possible outcomes of double stranded DNA cleavage and adapter ligation within the target region. For example, cleavage and adapter ligation at just after the third position of the target would produce the following sequence (5'-CTTCCGATCTACA-3' (SEQ ID NO:1742)) where the adapter and target sequences comprise 5'-CTTCCGATCT-3' (SEQ ID NO:1743) and 5'-ACA-3', respectively. Next, these sequences were searched for in the sequence datasets along with a 10 bp sequence 5' of the 7 bp PAM region (5'-AGTTGACCCA-3' (SEQ ID NO:1744)). Protospacer-adapter ligation positions where Illumina sequences were recovered in excess resulting in a peak or spike of read coverage over negative controls were denoted as the cleavage position (FIG. 9). Those Cas9 proteins that produced dominant cleavage at a protospacer position other than just after 3 were then re-examined by also capturing the cleavage product resulting from cleavage, end-repair, 3' adenine addition, and adapter ligation of protospacer side of the cleaved library target (FIG. 10A). Finally, the resulting frequencies were then compared for both the protospacer and PAM sides of cleavage and used to determine the position and type of cleavage taking T4 DNA polymerase end-repair into consideration (FIG. 10B).

Next, the sequences comprised of the dominant cleavage point were examined for PAM preferences. This was accomplished by isolating the PAM sequence from these reads and trimming away the 5' and 3' flanking sequences. Next, the frequency of the extracted PAM sequences was normalized to the original PAM library to account for bias inherent to the initial library. First, identical PAM sequences were enumerated, and frequency calculated versus the total reads in the dataset. Then, normalization was performed for each PAM using the following equation such that PAM sequences that were under- or over-represented in the initially library were accounted for:

Normalized Frequency=(Treatment Frequency)/
((((Control Frequency)/(Average Control Frequency)))

After normalization, a position frequency matrix (PFM) was calculated. This was done by weighting each nucleotide at each position based on the frequency (normalized) associated with each PAM. For example, if a PAM of 5'-CGGTAGC-3' had a normalized frequency of 0.15%, then the C at first position would be given a frequency of 0.15% when determining the nucleotide frequency for the first PAM position. Next, the overall contribution of each nucleotide at each position in the dataset was summed and organized into a table with the most abundant nucleotides indicating Cas9 PAM preferences (Tables 4-83, wherein: A=Adenine, C=Cytosine, G=Guanine, T=Thymine, R=A or G, Y=C or T, S=G or C, W=A or T, D=A or G or T, H=A or C or T, K=G or T, M=A or C, N=any base, B=C or G or T, V=A or C or G) and displayed as a WebLogo (FIG. 3).

IVT method results were confirmed with purified ribonucleoprotein (RNP), at several different concentrations. The WebLogo comparisons for selected Cas9 orthologs are shown in FIG. 8.

In all, a diverse range of PAM sequence preferences were obtained. These included novel G-rich, C-rich, A-rich, and T-rich PAM recognition. Additionally, approximately 10% of the Cas9 orthologs surveyed exhibited 5' staggered overhanging cleavage (1-3 nt) as opposed to a blunt DNA target cleavage pattern typified by other Cas9s. Taken together, this diversity presented by Cas9 orthologs provides a wealth of DNA target recognition and biophysical properties that may be harnessed for genome editing applications.

Example 3: Expression Analysis in E. coli Cells

Upon determination of the PAM requirements and functional sgRNA sequence, candidates of interest were selected for expression analysis in and purification from E. coli cells. Primary selection criteria include desirable or other interesting PAMs, genome editing activity, unusual cleavage patterns, and protein size. Candidate Cas9 nuclease encoding genes were sub-cloned into E. coli expression vectors, to yield constructs encoding fusion proteins comprising a C-terminal 6-His-tag. In some instances, sequences encoding nuclear localization sequences (SV40 origin) were incorporated onto the 5' and 3' ends of the Cas9 gene as well. The expression analysis may be performed in different E. coli strains under various growth conditions (media, temperature, induction) and detected by SDS-PAGE and Western blot analysis. At least some Cas9 proteins were soluble when expressed in E. coli, and soluble and stable when purified. Optimized conditions can be chosen for purification. Proteins were purified from cell lysate using standard IMAC and ion-exchange chromatography.

Cas9 proteins that were successfully purified at flask scale were advanced to expression trials in high-density bioreactors. Scalable purification schemes amenable to GMP (Good Manufacturing Practices) manufacture are determined. Optimal storage conditions and the stability of purified protein are determined using a combination of nano differential scanning fluorimetry (nanoDSF) and in vitro DNA endonuclease assays. DNA endonuclease assays are performed on fluorescently end-labeled DNA fragments and detected and quantified using capillary electrophoresis in 96-well plates.

Example 4: In Vitro Method for Modification of a Target Polynucleotide with Cas9 Ortholog Nuclease The compositions disclosed herein may be utilized outside of a typical cellular environment for in vitro modification of one or more target polynucleotides. In some aspects, the target polynucleotide is isolated and purified from a genomic source. In some aspects, the target polynucleotide is on a circularized or linearized plasmid. In some aspects, the target polynucleotide is a PCR product. In some aspects, the target polynucleotide is a synthesized oligonucleotide.

In some aspects, said modification includes binding to, nicking, or cleaving a target polynucleotide.

Materials

The following materials were used:
a. a Cas9 ortholog polypeptide, a cas9 ortholog polynucleotide, a functional Cas9 ortholog variant, a functional Cas9 ortholog fragment, a fusion protein comprising an active or deactivated Cas9 ortholog, a Cas9 ortholog further comprising one or more nuclear localization sequences (NLS) on the C-terminus or on the N-terminus or on both the N- and C-termini, a biotinylated Cas9 ortholog, a Cas9 ortholog nickase, a Cas9 ortholog endonuclease, a Cas9 ortholog further comprising a Histidine tag, a mixture of Cas9 orthologs with different PAM specificities, or a mixture of any two or more of the preceding.
b. 10× reaction buffer at pH 6.5: 200 mM HEPES, 50 mM MgCl2, 1M NaCl, 1 mM EDTA or equivalent buffer that supports activity
c. a proteinase (e.g., Proteinase K, molecular biology grade, New England BioLabs product #P8107S)
d. nuclease-free water
e. a sgRNA or other guide polynucleotide comprising the targeting sequence in the region of interest on the target (substrate) polynucleotide, wherein the targeting sequence is substantially complementary to a fragment of the target sequence of the target (substrate) polynucleotide
f. a target (substrate) polynucleotide, comprising the target sequence
g. It is preferred to keep the molar ratio of Cas9 and the sgRNA/guide polynucleotide per target site at a 1:1:1 or higher, to obtain the best cleavage efficiency.

Method

Each 30 ul reaction was assembled at room temperature:
1. 20 ul nuclease-free water
2. 3 ul 10× reaction buffer
3. sgRNA or other polypeptide
4. Cas9 ortholog or other molecule described in part a. of the Materials section The mixture was incubated at 25 degrees Celsius (or other temperature which supports ribonucleoprotein complex formation) for 1 or more minutes. Substrate polynucleotide was added. The mixture was mixed thoroughly and pulse-spun in a microfuge. The sample was incubated at 37 degrees Celsius (or other temperature that supports optimal activity) for 5 or more minutes. 1 ul of proteinase was added to each sample, which was then mixed thoroughly and pulse-spun in a microfuge. The sample was incubated at room temperature for 10 minutes, and prepared for subsequent analysis.

Example 5: In Vitro Characterization of Purified Proteins

Purified Cas9 proteins that were amenable to manufacturing (those that include desired stability, solubility, and/or other properties) were further characterized in vitro. First, the PAM sequences determined by the aforementioned assay were confirmed by standard plasmid DNA cleavage (Karvelis et al., 2015). The cleavage patterns of each Cas9 were tested using plasmid with optimal PAM and at least three different targets (different CG content). Next cleavage conditions and optimal sgRNA structure were determined using in vitro DNA endonuclease assays, and cell-based genome editing assays.

Data for some of the Cas9 orthologs tested with two different lengths of spacers (20 nucleotides and 24 nucleotides) is shown in FIG. 11.

Variants that showed similar or better in vitro cleavage efficiency than SpCas9 were selected for additional testing. Table 84 summarizes the in vitro and in vivo cleavage data obtained for a representative number of Cas9 orthologs.

Example 6: Evaluation of Homology-Directed Repair (HDR) Activity

Cleavage activity of novel Cas9 orthologs for certain target/targets in vitro, in cultured human cells, and in plant cells is determined. A cell line-based gain-of-function fluorescent reporter system is engineered for evaluation of HDR efficiency induced by a Cas9 protein. Briefly, the eGFP gene is inactivated by inserting region containing multiple STOP codons and PAMs for various novel Cas9s. Two approaches (FIG. 7) may be tested: i) the homology arms for repair (~500 bp) is duplicated in eGFP gene; ii) repair template is introduced into the cell together with Cas9. For direct comparison of different Cas9 proteins, the transfection efficiency and Cas9 expression are normalized.

Direct counting of green cells allows scoring for the HDR frequency, whereas subsequently performed T7 endonuclease assay (or deep sequencing) enables evaluation of the cleavage- and NHEJ efficiency in the same cells. These experiments lead to selection of novel Cas9 proteins with cleavage reparation output shifted to HDR. This system has the advantage of allowing for the direct comparison of HDR efficiency between Cas9 nuclease systems. The biophysical properties of the Cas9 orthologs is assessed, including: blunt-end or sticky overhang DNA cleavage, target site release, and frequency of recurrent target site cleavage. HDR analysis coupled with detailed characterization of in vitro DNA cleavage assists with connecting biophysical properties of Cas9 nucleases with desirable HDR outcomes.

Example 7: In Vivo Modification of a Plant Cell Target Polynucleotide with Cas9 Ortholog Nucleases In some aspects, the compositions disclosed herein may be utilized to modify a target polynucleotide in the genome of a cell. In some aspects, said cell is a eukaryotic cell. In one example of a eukaryotic cell, a plant cell is used. Transformation of a eukaryotic cell with a Cas9 ortholog to effect genomic polynucleotide editing can be accomplished by various methods known to be effective in plants, including particle-mediated delivery, *Agrobacterium*-mediated transformation, PEG-mediated delivery, and electroporation. It is appreciated that any method known in the art may be utilized. Example methods are described below.

To confer efficient expression, the novel Cas9 endonuclease gene, was optimized per standard techniques known in the art and the potato ST-LS1 intron 2 introduced in order to eliminate its expression in *E. coli* and *Agrobacterium*. To facilitate nuclear localization in maize cells, a nucleotide sequence encoding two versions of Simian virus 40 (SV40) monopartite nuclear localization signal was added to either the 5 prime, 3 prime, or both 5 prime and 3 prime ends. The resulting sequences encoding the different optimized Cas9 endonuclease gene and nuclear localization signal variants, were then operably linked to a promoter, for example a maize ubiquitin promoter, maize ubiquitin 5' untranslated region (UTR), maize ubiquitin intron 1, and suitable terminator, by standard molecular biological techniques.

The Cas9 endonuclease is directed by small RNAs (referred to herein as guide RNAs) to cleave double-stranded DNA. These guide RNAs comprise a sequence that aids recognition by Cas9 (referred to as Cas9 recognition domain) and a sequence that serves to direct Cas9 cleavage by base pairing with one strand of the DNA target site (Cas9 variable targeting domain). To transcribe small RNAs necessary for directing Cas9 endonuclease cleavage activity in maize cells, a U6 polymerase III promoter and terminator are isolated from maize and operably fused to the ends of DNA sequences that upon transcription would result in a suitable guide RNA for a Cas9 nuclease. To promote optimal transcription of the guide RNA from the maize U6 polymerase III promoter a G nucleotide was added to the 5' end of the sequence to be transcribed.

Particle-Mediated Delivery

Transformation of maize immature embryos using particle delivery is performed as follows. Media recipes follow below.

The ears are husked and surface sterilized in 30% Clorox bleach plus 0.5% Micro detergent for 20 minutes, and rinsed two times with sterile water. The immature embryos are isolated and placed embryo axis side down (scutellum side up), 25 embryos per plate, on 560Y medium for 4 hours and then aligned within the 2.5-cm target zone in preparation for bombardment. Alternatively, isolated embryos are placed on 560 L (Initiation medium) and placed in the dark at temperatures ranging from 26° C. to 37° C. for 8 to 24 hours prior to placing on 560Y for 4 hours at 26° C. prior to bombardment as described above.

Plasmids comprising the Cas9 ortholog and donor DNA are constructed using standard molecular biology techniques and co-bombarded with plasmids containing the developmental genes ODP2 (AP2 domain transcription factor ODP2 (Ovule development protein 2); US20090328252 A1) and Wushel (US2011/0167516).

The plasmids and DNA of interest are precipitated onto 0.6 micrometer (average diameter) gold pellets using a water-soluble cationic lipid transfection reagent as follows. DNA solution is prepared on ice using 1 ug of plasmid DNA and optionally other constructs for co-bombardment such as 50 ng (0.5 ul) of each plasmid containing the developmental genes ODP2 (AP2 domain transcription factor ODP2 (Ovule development protein 2); US20090328252 A1) and Wushel. To the pre-mixed DNA, 20 ul of prepared gold particles (15 mg/ml) and 5 ul of a water-soluble cationic lipid transfection reagent is added in water and mixed carefully. Gold particles are pelleted in a microfuge at 10,000 rpm for 1 min and supernatant is removed. The resulting pellet is carefully rinsed with 100 ml of 100% EtOH without resuspending the pellet and the EtOH rinse is carefully removed. 105 ul of 100% EtOH is added and the particles are resuspended by brief sonication. Then, 10 ul is spotted onto the center of each macrocarrier and allowed to dry about 2 minutes before bombardment.

Alternatively, the plasmids and DNA of interest are precipitated onto 1.1 um (average diameter) tungsten pellets using a calcium chloride (CaCl2) precipitation procedure by mixing 100 ul prepared tungsten particles in water, 10 ul (1 ug) DNA in Tris EDTA buffer (1 ug total DNA), 100 ul 2.5 M CaCl2, and 10 ul 0.1 M spermidine. Each reagent is added sequentially to the tungsten particle suspension, with mixing. The final mixture is sonicated briefly and allowed to incubate under constant vortexing for 10 minutes. After the precipitation period, the tubes are centrifuged briefly, liquid is removed, and the particles are washed with 500 ml 100% ethanol, followed by a 30 second centrifugation. Again, the liquid is removed, and 105 ul of 100% ethanol is added to the final tungsten particle pellet. For particle gun bombardment, the tungsten/DNA particles are briefly sonicated. 10 ul of the tungsten/DNA particles is spotted onto the center of each macrocarrier, after which the spotted particles are allowed to dry about 2 minutes before bombardment.

The sample plates are bombarded at level #4 with a Biorad Helium Gun. All samples receive a single shot at 450 PSI, with a total of ten aliquots taken from each tube of prepared particles/DNA.

Following bombardment, the embryos are incubated on 560P (maintenance medium) for 12 to 48 hours at temperatures ranging from 26 C to 37 C, and then placed at 26 C. After 5 to 7 days the embryos are transferred to 560R selection medium containing 3 mg/liter Bialaphos, and subcultured every 2 weeks at 26 C. After approximately 10 weeks of selection, selection-resistant callus clones are transferred to 288 J medium to initiate plant regeneration. Following somatic embryo maturation (2-4 weeks), well-developed somatic embryos are transferred to medium for germination and transferred to a lighted culture room. Approximately 7-10 days later, developing plantlets are transferred to 272V hormone-free medium in tubes for 7-10 days until plantlets are well established. Plants are then transferred to inserts in flats (equivalent to a 2.5" pot) containing potting soil and grown for 1 week in a growth chamber, subsequently grown an additional 1-2 weeks in the greenhouse, then transferred to Classic 600 pots (1.6 gallon) and grown to maturity. Plants are monitored and scored for transformation efficiency, and/or modification of regenerative capabilities.

Initiation medium (560 L) comprises 4.0 g/l N6 basal salts (SIGMA C-1416), 1.0 ml/l Eriksson's Vitamin Mix (1000× SIGMA-1511), 0.5 mg/l thiamine HCl, 20.0 g/l sucrose, 1.0 mg/l 2,4-D, and 2.88 g/l L-proline (brought to volume with D-I H2O following adjustment to pH 5.8 with KOH); 2.0 g/l Gelrite (added after bringing to volume with D-I H2O); and 8.5 mg/l silver nitrate (added after sterilizing the medium and cooling to room temperature).

Maintenance medium (560P) comprises 4.0 g/l N6 basal salts (SIGMA C-1416), 1.0 ml/l Eriksson's Vitamin Mix (1000× SIGMA-1511), 0.5 mg/l thiamine HCl, 30.0 g/l sucrose, 2.0 mg/l 2,4-D, and 0.69 g/l L-proline (brought to volume with D-I $H_2O$ following adjustment to pH 5.8 with KOH); 3.0 g/l Gelrite (added after bringing to volume with D-I H2O); and 0.85 mg/l silver nitrate (added after sterilizing the medium and cooling to room temperature).

Bombardment medium (560Y) comprises 4.0 g/l N6 basal salts (SIGMA C-1416), 1.0 ml/l Eriksson's Vitamin Mix (1000× SIGMA-1511), 0.5 mg/l thiamine HCl, 120.0 g/l sucrose, 1.0 mg/l 2,4-D, and 2.88 g/l L-proline (brought to volume with D-I $H_2O$ following adjustment to pH 5.8 with KOH); 2.0 g/l Gelrite (added after bringing to volume with D-I H2O); and 8.5 mg/l silver nitrate (added after sterilizing the medium and cooling to room temperature).

Selection medium (560R) comprises 4.0 g/l N6 basal salts (SIGMA C-1416), 1.0 ml/l Eriksson's Vitamin Mix (1000× SIGMA-1511), 0.5 mg/l thiamine HCl, 30.0 g/l sucrose, and 2.0 mg/l 2,4-D (brought to volume with D-I H2O following adjustment to pH 5.8 with KOH); 3.0 g/l Gelrite (added after bringing to volume with D-I H2O); and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I $H_2O$) (Murashige and Skoog (1962) Physiol. Plant. 15:473), 100 mg/l myo-inositol, 0.5 mg/l zeatin, 60 g/l sucrose, and 1.0 ml/l of 0.1 mM abscisic acid (brought to volume with polished D-I $H_2O$ after adjusting to pH 5.6); 3.0 g/l Gelrite (added after bringing to volume with D-I H2O); and 1.0 mg/l indoleacetic acid and 3.0 mg/l bialaphos (added after sterilizing the medium and cooling to 60° C.).

Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL, and 0.40 g/l glycine brought to volume with polished D-I H2O), 0.1 g/l myo-inositol, and 40.0 g/l sucrose (brought to volume with polished D-I $H_2O$ after adjusting pH to 5.6); and 6 g/l bacto-agar (added after bringing to volume with polished D-I H2O), sterilized and cooled to 60° C.

The delivery of RNP (fibonucleoprotein) in to cells, including plant or animal cells, has several advantages compared to plasmid or RNA. When intact complex is delivered in to cell, the DNA may be modified faster and with higher efficiency. In addition, the concentration of Cas9 may be controlled more strictly in this case, potentially lowering the rate of off-targets.

For maize transformation, particle gun transformation of Hi-Type II 8 to 10-day-old immature embryos (IEs) was carried-out similar to that described previously (Svitashev et al. 2015 and Karvelis et al. 2015). Briefly, DNA expression cassettes were co-precipitated onto 0.6 µM (average size) gold particles utilizing TranslT-2020, pelleted by centrifugation, washed with absolute ethanol and re-dispersed by sonication. Following sonication, 10 µl of the DNA coated gold particles were loaded onto a macrocarrier and air dried. Next, biolistic transformation was performed using a PDS-1000/He Gun (Bio-Rad) with a 425 lb per square inch rupture disc. Since particle gun transformation can be highly variable, a visual marker DNA expression cassette encoding a cyan fluorescent protein (CFP) was also co-delivered to aid in the selection of evenly transformed IEs and each treatment was performed in triplicate.

*Agrobacterium*-Mediated Transformation

*Agrobacterium*-mediated transformation is performed essentially as described in Djukanovic et al. (2006) Plant Biotech J 4:345-57. Briefly, 10-12 day old immature embryos (0.8-2.5 mm in size) are dissected from sterilized kernels and placed into liquid medium (4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.690 g/L L-proline, 68.5 g/L sucrose, 36.0 g/L glucose, pH 5.2). After embryo collection, the medium is replaced with 1 ml *Agrobacterium* at a concentration of 0.35-0.45 OD550. Maize embryos are incubated with *Agrobacterium* for 5 min at room temperature, then the mixture is poured onto a media plate containing 4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.690 g/L L-proline, 30.0 g/L sucrose, 0.85 mg/L silver nitrate, 0.1 nM acetosyringone, and 3.0 g/L Gelrite, pH 5.8. Embryos are incubated axis down, in the dark for 3 days at 20° C., then incubated 4 days in the dark at 28° C., then transferred onto new media plates containing 4.0 g/L N6 Basal Salts (Sigma C-1416), 1.0 ml/L Eriksson's Vitamin Mix (Sigma E-1511), 1.0 mg/L thiamine HCl, 1.5 mg/L 2, 4-D, 0.69 g/L L-proline, 30.0 g/L sucrose, 0.5 g/L MES buffer, 0.85 mg/L silver nitrate, 3.0 mg/L Bialaphos, 100 mg/L carbenicillin, and 6.0 g/L agar, pH 5.8. Embryos are subcultured every three weeks until transgenic events are identified. Somatic embryogenesis are induced by transferring a small amount of tissue onto regeneration medium (4.3 g/L MS salts (Gibco 11117), 5.0 ml/L MS Vitamins Stock Solution, 100 mg/L myo-inositol, 0.1 µM ABA, 1 mg/L IAA, 0.5 mg/L zeatin, 60.0 g/L sucrose, 1.5 mg/L Bialaphos, 100 mg/L carbenicillin, 3.0 g/L Gelrite, pH 5.6) and incubation in the dark for two weeks at 28° C. All material with visible shoots and roots are transferred onto media containing 4.3 g/L MS salts (Gibco 11117), 5.0 ml/L MS Vitamins Stock Solution, 100 mg/L myo-inositol, 40.0 g/L sucrose, 1.5 g/L Gelrite, pH 5.6, and incubated under artificial light at 28° C. One week later, plantlets are moved into glass tubes containing the same medium and grown until they were sampled and/or transplanted into soil.

Ribonucleoprotein Transformation

A Cas9 and associated guide polynucleotide(s) ribonucleoprotein (RNP) complex can be recombinantly expressed and purified. RNP complex assembly can be carried-out directly in the cell recombinantly expressing the components or in vitro. Following purification, the RNP complex(es) can be delivered by particle gun transformation as described in Svitashev, S. et al. (2016) Nat. Commun. 7:13274. Briefly, RNPs (and optionally DNA expression) are precipitated onto 0.6 mm (average diameter) gold particles (Bio-Rad, USA) using a water soluble cationic lipid TransIT-2020 (Mirus, USA) as follows: 50 ml of gold particles (water suspension of 10 mg/ml) and 2 ml of TransIT-2020 water solution are added to the premixed RNPs (and optionally DNA expression vectors), mixed gently, and incubated on ice for 10 min. RNP/DNA-coated gold particles are then pelleted in a microfuge at 8,000 g for 30 s and supernatant is removed. The pellet is then resuspended in 50 ml of sterile water by brief sonication. Immediately after sonication, coated gold particles are loaded onto a microcarrier (10 ml each) and allowed to air dry. Immature maize embryos, 8-10 days after pollination, are then bombarded using a PDS-1000/He Gun (Bio-Rad, USA) with a rupture pressure of 425 pounds per inch square. Post-bombardment culture, selection, and plant regeneration are performed as previously described above.

Variations in Delivery

Cas9 and guide polynucleotide can be delivered as DNA expression cassettes, RNA, messenger RNA (5'-capped and polyadenylated), or protein or combinations thereof. Cell lines or transformants can also be established stably expressing all but one or more of the components needed to form a functional guide polynucleotide/Cas complex so that upon delivery of the missing component(s) a functional guide polynucleotide/Cas complex can form.

Sequence Verification of Genomic Polynucleotide Modification

Samples of a transformed plant are obtained and sequenced via any method known in the art, and compared to the genomic sequences of an isoline plant not transformed with the Cas9 and/or guide polynucleotide. The presence of non-homologous end-joining (NHEJ) insertion and/or deletion (indel) mutations resulting from DNA repair can also be used as a signature to detect cleavage activity.

This can be performed 2 days or longer after transformation. A variety of tissues can be samples, included but not limited to callus and leaf tissue. Total genomic DNA can be extracted and the region surrounding the intended target site can be PCR amplified with Phusion® HighFidelity PCR Master Mix (New England Biolabs, M0531L) adding on the sequences necessary for amplicon-specific barcodes and Illumina sequencing using "tailed" primers through two rounds of PCR and deep sequenced. The resulting reads can then examined for the presence of mutations at the expected site of cleavage by comparison to control experiments where the small RNA transcriptional cassette is omitted from the transformation.

Sequence Verification of Genomic Polynucleotide Modification

The cellular cleavage activity of Cas9 orthologs was assessed in Zea mays using a rapid transient assay as described previously (Svitashev et al. 2015 and Karvelis et al. 2015). Briefly, after 2 days, the 20-30 most evenly transformed IEs were harvested based on their fluorescence. Total genomic DNA was extracted and the region surrounding the intended target site was PCR amplified with Phusion® HighFidelity PCR Master Mix (New England Biolabs, M0531L) adding on the sequences necessary for amplicon-specific barcodes and Illumina sequencing using "tailed" primers through two rounds of PCR and deep sequenced. The resulting reads were then examined for the presence of mutations at the expected site of cleavage by comparison to control experiments where the small RNA transcriptional cassette is omitted from the transformation.

FIG. 16 shows the results of two different Cas9 orthologs (ID33 and ID64) across three different target sites (MS45, MS26, and LIG) in maize T0 plants, as compared to control plants modified with *S. pyogenes* Cas9. FIGS. 15 and 19 show the mutant read results of Cas9 orthologs ID33 (FIG. 15A), ID64 (FIG. 15B), ID46 (FIG. 19A), and ID56 (FIG. 19B), in maize cells.

Example 8: In Vivo Modification of a Human Cell Target Polynucleotide with Cas9 Ortholog Nucleases The genome editing activity of selected Cas9 proteins is measured in the human model cell line HEK293. Cells are co-transfected with plasmids encoding Cas9 candidates together with U6-driven dsDNA encoding their cognate sgRNA. This approach does not require purified protein and is initiated once the PAM preferences and sgRNA(s) supportive of cleavage activity are determined. Targeting endogenous genes allows evaluation of the activity of the selected Cas9s on chromosomal DNA. The targeting frequencies of endogenous human genes is tested using a T7 endonuclease assay and then evaluated by deep sequencing PCR amplicons spanning the targeted regions. Wild-type and mutant amplicons are counted to derive editing scores. Editing scores for each target are combined to obtain an aggregate score. Three to five different targets for each Cas9 protein are tested. Genome editing activity for selected Cas9 candidates are compared to activity for SpCas9 in parallel transfections. For candidate Cas9 nucleases, nearby or overlapping (if possible) target locations are targeted, matching target GC content as closely as possible to SpCas9 targets.

Deep sequencing not only allows comparison of cleavage efficiencies of investigated Cas9 proteins, but also provides valuable information about dominant NHEJ repair outcomes for dsDNA breaks generated with each of the novel Cas9 orthologs. The delivery of RNP (ribonucleoprotein) in to cells, including plant or animal cells, has several advantages compared to plasmid or RNA. When intact complex is delivered in to cell, the DNA may be modified faster and with higher efficiency. In addition, the concentration of Cas9 may be controlled more strictly in this case, potentially lowering the rate of off-targets. To validate the functional activity of novel Cas9 nucleases in human cells, RNP complexes are assembled using purified proteins and in vitro transcribed sgRNAs. RNPs are introduced into HEK293 cells by electroporation. Genome editing activity is assessed as described above using T7 endonuclease I assays and deep sequencing of amplicons corresponding to genomic targets. Genome editing efficiency of novel Cas9 variants are compared to that of SpCas9. Variants that show similar or better genome editing efficiency than SpCas9 bearing the same NLS and His-tag sequences are selected. This approach allows prediction of the functional activity of new Cas9 nucleases when introduced as RNP into model cells, which is useful for the development of new methods for delivery of gene editing tools.

Cell Culture Electroporation

Cas9 RNPs were electroporated into HEK293 (ATCC Cat# CRL-1573) cells using the Lonza 4D-Nucleofector System and the SF Cell Line 4D-Nucleofector® X Kit (Lonza). For each electroporation, RNPs were formed by incubating 100 pmoles of sgRNA with 50 pmoles of Cas9 protein in nucleofector solution in a volume of 17 µL at room temperature for 20 minutes. HEK293 cells were released from culture vessels using TrypLE™ Express Enzyme 1× (ThermoFisher) washed with 1×PBS without Ca++ or Mg++ (ThermoFisher) and counted using a XXX LUNA™ Automated Cell Counter (Logos Biosystems)XXX. For each electroporation, 1×10^5 live cells were resuspended in 9 µL electroporation solution. Cells and RNP were mixed and transferred to one well of a 16-well strip and electroporated using the CM-130 program. 754, of pre-warmed culture was added to each well and 10 µL of the resultant resuspended cells were dispensed into a well of a 96-well culture vessel containing 125 µL of pre-warmed culture medium. Electroporated cells were incubated at 37° C., 5% CO2 in a humidified incubator for 48 hours before analysis of genome editing.

Cell Culture Lipofection

Human embryonic kidney (HEK) cell line 293 (ATCC-CRL-1573) was maintained in Dulbecco's modified Eagle's Medium (DMEM) with GlutaMAX (Thermo Fisher Scientific), supplemented with 10% fetal bovine serum (Thermo Fisher Scientific) and 10,000 units/mL penicillin, and 10,000 µg/mL streptomycin (Thermo Fisher Scientific) at 37° C. with 5% CO2 incubation.

HEK293 cells were seeded into 96-well plates (Thermo Fisher Scientific) one day prior to transfection at a density of 18,000 cells per well. Cells were transfected using Lipofectamine 3000 (Thermo Fisher Scientific) following the manufacturer's recommended protocol. For each well of a 96-well plate a total amount of 200 ng DNA containing 30 fmol of plasmid Cas9 encoding plasmid and 27 fmol of PCR fragment with appropriate U6-gRNA template was used.

Cells were incubated at 37° C. for 48 hours post transfection in 5% CO2 before genomic DNA extraction. The cells were washed twice with 200 µl 1×DPBS (Thermo Fisher Scientific) and resuspended in 25 µl 50 mM Tris-HCl, 150 mM NaCl, 0.05% Tween 20, pH 7.6 (Sigma Aldrich) and 0.2 mg/ml Proteinase K (Thermo Fisher Scientific) lysis buffer. Resuspended cells were incubated at 55° C. for 30 minutes and 98° C. for 20 minutes. Genomic region surrounding each Cas9 target site was PCR amplified using primers X and Y and analyzed with T7 endonuclease as described above.

Sequence Verification of Genomic Polynucleotide Modification

For genome editing analysis, genomic DNA was extracted 48 h post electroporation using 50 µL of Epicentre QuickExtract™ DNA Extraction Solution for each well of a 96-well culture vessel according the to the manufacturer's recommendations. Regions surrounding the intended target sites were PCR amplified using Q5® Hot Start High-Fidelity 2× Master Mix (NEB) according to the manufacturer's suggestion, and using 2 µL of genomic DNA (diluted 1:5 in water) in 25 µL reactions.

Genome editing was estimated using T7 Endonuclease I assays. 5 µL of each PCR reaction was combined with 2 µL NEBuffer 2 (NEB) and 12 µL of water before denaturation at 95° C. for 5 minutes and re-annealing by temperature ramping from 95-85° C. at −2° C./s followed by ramping from 85-25° C. at −0.1° C./s. 1 µL of T7 Endonuclease I (NEB) was added to each re-annealed sample and cleavage reactions were incubated at 37° C. for 15 min. Reactions were stopped by adding 1 µL of Proteinase K (NEB) per sample and incubation at 25° C. for 5 min. Fragments were analysed on an AATI Fragment Analyzer (AATI) using the CRISPR Discovery Gel Kit reagents (AATI).

Genome editing outcomes were characterized by deep sequencing of PCR amplicons from targeted loci. Illumina sequencing libraries were constructed using the NEBNext® Ultra™ II DNA Library Prep Kit for Illumina® and NEB-Next® Multiplex Oligos for Illumina® (96 Index Primers) (NEB) according to the manufacturer's suggestion. After sequencing, reads were examined for the presence of mutations at the expected site of cleavage by comparison to control experiments where RNPs targeted a different region of the genome.

FIG. 17 shows the results of selected Cas9 orthologs at the HEK cell WTAP locus, as compared to the activity of *S. pyogenes* Cas9, in cells transformed with a recombinant construct comprising a DNA sequence encoding the respective Cas9 ortholog.

FIG. 18 shows the results of selected Cas9 orthologs at the HEK cell RunX1 locus, as compared to the activity of *S. pyogenes* Cas9, in cells transformed with a recombinant construct comprising a DNA sequence encoding the respective Cas9 ortholog.

FIG. 20 shows the results of selected Cas9 orthologs at the HEK cell WTAP locus, as compared to the activity of *S. pyogenes* Cas9, in cells transformed with ribonucleoprotein comprising the respective Cas9 ortholog and its appropriate guide RNA.

Example 9: Analysis of Cas9 Orthologs to Identify Key Residues, Predict Ortholog Activity, and Methods for Design of Variants Amino acid residues that were conserved in active Cas9s and under-represented in non-active Cas9s were identified. This was accomplished by first aligning orthologs using MUSCLE (default parameters). Next, each position was parsed and the frequency of each amino acid at each position was assessed. Next, the overall fraction of each amino acid at each position in the active and non-active datasets were defined by summing and dividing by the total number in each dataset, respectively. Then, the non-active dataset was subtracted from the active with positive values indicating conserved amino acids in the active Cas9s that were under-represented in the non-active collection. Finally, key positions defining an active Cas9 were hand curated by selecting only those locations with a score greater than or equal to +0.4 where at least 5 of the 7 active Cas9s exhibited the conserved and under-represented amino acid (FIG. 21 and Table 86A).

After defining a set of structural features ("fingerprints") for active Cas9s (all identified fingerprint positions listed in Table 86B), Cas9 orthologs were scored as summations of position scores. The maximum score of the method described herein was 12.52 and the minimum score was 0. After evaluating a diverse collection of Cas9s, scores ranged from 11.64 to 0.4. Many of the Cas9s experimentally determined to be active in eukaryotic cells were found to be in the top 8-10% of activity scores. All active Cas9 orthologs had at least one of the identified structural features. Table 86C shows the calculated activity categories for each of the Cas9 orthologs disclosed herein (by SEQ ID). Orthologs with a score greater than the median score (3.14) are predicted to have positive cutting activity in a eukaryotic cell. Other orthologs may have activity as well.

Using the methods described herein, the activity score, structural fingerprint, and category may be determined for any Cas9 ortholog. These or similar methods can be used to predict the activity of Cas9 orthologs, define key amino acids and structural features required for an active Cas9, define the residues responsible for sticky or blunt cleavage activity, and provide residues and regions for the generation of engineered variants.

Cas9 ortholog variants with different desired properties such as but not limited to: altered PAM recognition sequence, modified specificity, and/or altered cleavage activity may be engineered by analyzing the sequence-structure-function relationships of the Cas9 orthologs described herein. In some aspects, the evolution of functionally important domains (e.g., PI domains) is analyzed. In some aspects, information about conserved and non-conserved amino acids or amino acid motifs is utilized to predict activity of Cas9 orthologs and to design possible mutations in a Cas9 protein that may modulate activity or a molecular property. In some aspects, rational design is used. In some aspects, random mutagenesis is used. In some aspects, directed evolution is used. In some aspects, a combination of rational design, random mutagenesis, and directed evolution are used.

Following generation of variants, Cas9 ortholog variants are selected and tested to determine the PAM sequence, activity in cultured cells (e.g., human or plant), purified, and/or further characterized.

TABLES

TABLE 1

Cas9 orthologs selected for characterization
SEQ IDs of the gene ORFs and translated encoded protein, whole Cas9
protein phylogenetic clade, unique ID#, and source organism are listed.

| NT SEQID | PRT SEQID | Ortholog ID# | Clade | Source Organism |
|---|---|---|---|---|
| 1 | 86 | 2 | 1 | *Prevotella histicola* |
| 2 | 87 | 3 | 1 | *Chryseobacterium gallinarum* |
| 3 | 88 | 4 | 1 | *Parabacteroides* sp. |
| 4 | 89 | 5 | 1 | *Capnocytophaga canis* |
| 5 | 90 | 6 | 1 | *Ornithobacterium rhinotracheale* |
| 6 | 91 | 8 | 1 | *Weeksella virosa* |
| 7 | 92 | 9 | 1 | *Flavobacterium frigidarium* |
| 8 | 93 | 12 | 2 | *Rikenellaceae* sp. |
| 9 | 94 | 13 | 2 | *Jejuia pallidilutea* |
| 10 | 95 | 16 | 3 | *Caenispirillum salinarum* |
| 11 | 96 | 17 | 3 | *Salinispira pacifica* |
| 12 | 97 | 18 | 3 | *Sulfitobacter donghicola* |
| 13 | 98 | 19 | 3 | *Mucispirillum schaedleri* |
| 14 | 99 | 21 | 3 | *Mesorhizobium* sp. |
| 15 | 100 | 27 | 5 | *Neisseria meningitidis* |
| 16 | 101 | 28 | 5 | *Geobacillus* sp. |
| 17 | 102 | 29 | 5 | *Bacillus okhensis* |
| 18 | 103 | 30 | 5 | *Tistrella mobilis* |
| 19 | 104 | 32 | 5 | *Kingella kingae* |
| 20 | 105 | 33 | 5 | *Clostridium perfringens* |
| 21 | 106 | 35 | 5 | *Neisseria* sp. |
| 22 | 107 | 41 | 5 | *Campylobacter coli* |
| 23 | 108 | 43 | 5 | *Sulfurospirillum* sp. |
| 24 | 109 | 44 | 5 | *Dechloromonas denitrificans* |
| 25 | 110 | 46 | 6 | *Nitratifractor salsuginis* |
| 26 | 111 | 47 | 7 | *Enterococcus cecorum* |
| 27 | 112 | 48 | 7 | *Facklamia hominis* |
| 28 | 113 | 50 | 7 | *Streptococcus sinensis* |
| 29 | 114 | 51 | 7 | *Eubacterium dolichum* |
| 30 | 115 | 52 | 7 | *Streptococcus macedonicus* |
| 31 | 116 | 56 | 7 | *Turicibacter* sp. |
| 32 | 117 | 60 | 7 | *Bacillus niameyensis* |
| 33 | 118 | 61 | 7 | *Massilibacterium senegalense* |
| 34 | 119 | 63 | 8 | *Kurthia huakuii* |
| 35 | 120 | 64 | 9 | *Streptococcus equinus* |
| 36 | 121 | 65 | 9 | *Streptococcus equi* |
| 37 | 122 | 66 | 9 | *Enterococcus faecium* |
| 38 | 123 | 67 | 9 | *Enterococcus italicus* |
| 39 | 124 | 68 | 9 | *Streptococcus agalactiae* |
| 40 | 125 | 70 | 9 | *Streptococcus ratti* |
| 41 | 126 | 71 | 9 | *Listeria monocytogenes* |
| 42 | 127 | 77 | 10 | *Lactobacillus* sp. |
| 43 | 128 | 78 | 10 | *Pediococcus acidilactici* |
| 44 | 129 | 79 | 10 | *Acidaminococcus* sp. |
| 45 | 130 | 80 | 10 | *Lactobacillus* sp. |
| 46 | 131 | 81 | 10 | *Treponema putidum* |
| 47 | 132 | 87 | 10 | *Eubacterium* sp. |
| 48 | 133 | 94 | 11 | *Bifidobacterium bombi* |
| 49 | 134 | 97 | 11 | *Corynebacterium camporealensis* |
| 50 | 135 | 102 | 12 | *Legionella pneumophila* |
| 51 | 136 | 83 | 1 | Environmental metagenome |
| 52 | 137 | 84 | 1 | Environmental metagenome |
| 53 | 138 | 85 | 5 | Environmental metagenome |
| 54 | 139 | 88 | 5 | Environmental metagenome |
| 55 | 140 | 91 | 3 | Environmental metagenome |

TABLE 1-continued

Cas9 orthologs selected for characterization
SEQ IDs of the gene ORFs and translated encoded protein, whole Cas9
protein phylogenetic clade, unique ID#, and source organism are listed.

| NT SEQID | PRT SEQID | Ortholog ID# | Clade | Source Organism |
|---|---|---|---|---|
| 56 | 141 | 93 | 3 | Environmental metagenome |
| 57 | 142 | 139 | 3 | Environmental metagenome |
| 58 | 143 | 96 | 5 | Environmental metagenome |
| 59 | 144 | 98 | 3 | Environmental metagenome |
| 60 | 145 | 101 | 3 | Environmental metagenome |
| 61 | 146 | 103 | 2 | Environmental metagenome |
| 62 | 147 | 104 | 1 | Environmental metagenome |
| 63 | 148 | 105 | 2 | Environmental metagenome |
| 64 | 149 | 106 | 10 | Acidaminococcus_intestini_RyC-MR95 |
| 65 | 150 | 107 | 8 | Coriobacterium_glomerans_PW2 |
| 66 | 151 | 108 | 8 | Eggerthella_sp._YY7918 |
| 67 | 152 | 109 | 10 | Finegoldia_magna_ATCC_29328 |
| 68 | 153 | 112 | 10 | Lactobacillus_rhamnosus_LOCK900 |
| 69 | 154 | 116 | 7 | Mycoplasma_gallisepticum_CA06 |
| 70 | 155 | 119 | 9 | Streptococcus_agalactiae_NEM316 |
| 71 | 156 | 120 | 9 | Streptococcus_dysgalactiae_subsp._equisimilis_AC-2713 |
| 72 | 157 | 121 | 9 | Streptococcus_gallolyticus_subsp._gallolyticus_ATCC_43143 |
| 73 | 158 | 122 | 7 | Streptococcus_gordonii_str._Challis_substr._CH1 |
| 74 | 159 | 123 | 9 | Streptococcus_mutans_GS-5] |
| 75 | 160 | 124 | 7 | Streptococcus_salivarius_JIM8777 |
| 76 | 161 | 125 | 7 | Streptococcus_suis_D9 |
| 77 | 162 | 126 | 7 | Streptococcus_thermophilus_LMG_18311 |
| 78 | 163 | 127 | 10 | Treponema_denticola_ATCC_35405 |
| 79 | 164 | 131 | 9 | *Lactobacillus animalis* KCTC 3501 |
| 80 | 165 | 132 | 10 | *Lactobacillus ceti* DSM 22408 |
| 81 | 166 | 136 | 9 | *Tissierellia bacterium* KA00581 |
| 82 | 167 | 138 | 10 | *Veillonella parvula* ATCC 17745 |
| 83 | 168 | 141 | 7 | *Streptococcus gallolyticus* |
| 84 | 169 | 142 | 7 | *Staphylococcus pasteuri* |
| 85 | 170 | 140 | 9 | *Enterococcus faecalis* OG1RF |

TABLE 2A

Amino acid positions of Cas9 ortholog domains
The Cas9 orthologs were grouped by sequence similarities with the largest variation at
the REC domain. To determine the functional domain boundary, the Cas9 candidate
sequences of Group I, II, III, IV, V and VI were aligned with their closest homologous
sequences of known high resolution 3D structures, including PDBID: 5czz, 5czz, 4un3,
4oge, 4oge, and 5b2o, respectively. Based on these alignments, each candidate sequence
was threaded into its corresponding structural template for modeling, and the domain
boundaries were assigned according to the template's domain definition in the
associated publication references.

| ID# | PRT SEQID | RuvCI start | RUVC1 end | BH start | BH end | REC start | REC end | RuvCII start | RUVCII end |
|---|---|---|---|---|---|---|---|---|---|
| GROUP I | | | | | | | | | |
| 12 | 93 | 1 | 41 | 42 | 81 | 82 | 518 | 519 | 622 |
| 18 | 97 | 1 | 40 | 41 | 78 | 79 | 458 | 459 | 558 |
| 19 | 98 | 1 | 48 | 49 | 86 | 87 | 448 | 449 | 548 |
| 21 | 99 | 1 | 51 | 52 | 89 | 90 | 503 | 504 | 605 |
| 27 | 100 | 1 | 51 | 52 | 89 | 90 | 458 | 459 | 538 |
| 28 | 101 | 1 | 39 | 40 | 77 | 78 | 456 | 457 | 534 |
| 29 | 102 | 1 | 50 | 51 | 88 | 89 | 462 | 463 | 541 |
| 30 | 103 | 1 | 47 | 48 | 85 | 86 | 450 | 451 | 538 |
| 32 | 104 | 1 | 48 | 49 | 86 | 87 | 457 | 458 | 537 |
| 33 | 105 | 1 | 43 | 44 | 81 | 82 | 455 | 456 | 535 |
| 35 | 106 | 1 | 48 | 49 | 86 | 87 | 461 | 462 | 541 |
| 41 | 107 | 1 | 36 | 37 | 74 | 75 | 439 | 440 | 521 |
| 43 | 108 | 1 | 45 | 46 | 82 | 83 | 453 | 454 | 537 |
| 44 | 109 | 1 | 39 | 40 | 77 | 78 | 474 | 475 | 570 |
| 46 | 110 | 1 | 46 | 47 | 85 | 86 | 487 | 488 | 572 |
| 47 | 111 | 1 | 42 | 43 | 76 | 77 | 462 | 463 | 543 |
| 48 | 112 | 1 | 37 | 38 | 71 | 72 | 466 | 467 | 549 |
| 50 | 113 | 1 | 39 | 40 | 73 | 74 | 462 | 463 | 542 |
| 51 | 114 | 1 | 39 | 40 | 73 | 74 | 434 | 435 | 513 |
| 52 | 115 | 1 | 40 | 41 | 74 | 75 | 461 | 462 | 542 |
| 56 | 116 | 1 | 38 | 39 | 72 | 73 | 449 | 450 | 530 |
| 60 | 117 | 1 | 41 | 42 | 75 | 76 | 451 | 452 | 530 |

TABLE 2A-continued

Amino acid positions of Cas9 ortholog domains
The Cas9 orthologs were grouped by sequence similarities with the largest variation at the REC domain. To determine the functional domain boundary, the Cas9 candidate sequences of Group I, II, III, IV, V and VI were aligned with their closest homologous sequences of known high resolution 3D structures, including PDBID: 5czz, 5czz, 4un3, 4oge, 4oge, and 5b2o, respectively. Based on these alignments, each candidate sequence was threaded into its corresponding structural template for modeling, and the domain boundaries were assigned according to the template's domain definition in the associated publication references.

| | | | | | | | | | |
|---|---|---|---|---|---|---|---|---|---|
| 61 | 118 | 1 | 40 | 41 | 73 | 74 | 437 | 438 | 518 |
| 83 | 136 | 1 | 58 | 59 | 100 | 101 | 456 | 457 | 515 |
| 84 | 137 | 1 | 44 | 45 | 88 | 89 | 622 | 623 | 674 |
| 85 | 138 | 1 | 42 | 43 | 83 | 84 | 456 | 457 | 515 |
| 88 | 139 | 1 | 39 | 40 | 77 | 78 | 447 | 448 | 502 |
| 91 | 140 | 1 | 43 | 44 | 87 | 88 | 482 | 483 | 558 |
| 93 | 141 | 1 | 43 | 44 | 81 | 82 | 463 | 464 | 526 |
| 139 | 142 | 1 | 39 | 40 | 82 | 83 | 600 | 601 | 653 |
| 96 | 143 | 1 | 45 | 46 | 83 | 84 | 450 | 451 | 508 |
| 98 | 144 | 1 | 47 | 48 | 85 | 86 | 472 | 473 | 549 |
| 101 | 145 | 1 | 42 | 43 | 80 | 81 | 448 | 449 | 505 |
| 103 | 146 | 1 | 41 | 42 | 79 | 80 | 451 | 452 | 502 |
| 105 | 148 | 1 | 45 | 46 | 87 | 88 | 511 | 512 | 571 |
| 122 | 158 | 1 | 40 | 41 | 73 | 74 | 459 | 460 | 514 |
| 124 | 160 | 1 | 40 | 41 | 73 | 74 | 466 | 467 | 521 |
| 125 | 161 | 1 | 41 | 42 | 74 | 75 | 460 | 461 | 515 |
| 126 | 162 | 1 | 40 | 41 | 73 | 74 | 460 | 461 | 515 |
| 141 | 168 | 1 | 41 | 42 | 74 | 75 | 460 | 461 | 515 |
| 142 | 169 | 1 | 41 | 42 | 74 | 75 | 430 | 431 | 485 |
| GROUP II | | | | | | | | | |
| 17 | 96 | 1 | 40 | 41 | 86 | 87 | 538 | 539 | 629 |
| GROUP III | | | | | | | | | |
| 2 | 86 | 1 | 58 | 59 | 94 | 95 | 637 | 638 | 692 |
| 3 | 87 | 1 | 59 | 60 | 96 | 97 | 653 | 654 | 707 |
| 4 | 88 | 1 | 58 | 59 | 94 | 95 | 669 | 670 | 724 |
| 5 | 89 | 1 | 58 | 59 | 94 | 95 | 672 | 673 | 733 |
| 6 | 90 | 1 | 59 | 60 | 94 | 95 | 695 | 696 | 755 |
| 8 | 91 | 1 | 58 | 59 | 92 | 93 | 703 | 704 | 763 |
| 9 | 92 | 1 | 58 | 59 | 93 | 94 | 612 | 613 | 674 |
| 13 | 94 | 1 | 47 | 48 | 82 | 83 | 722 | 723 | 783 |
| 63 | 119 | 1 | 44 | 45 | 77 | 78 | 719 | 720 | 774 |
| 64 | 120 | 1 | 59 | 60 | 94 | 95 | 716 | 717 | 772 |
| 65 | 121 | 1 | 59 | 60 | 94 | 95 | 715 | 716 | 771 |
| 66 | 122 | 1 | 59 | 60 | 94 | 95 | 728 | 729 | 784 |
| 67 | 123 | 1 | 59 | 60 | 94 | 95 | 720 | 721 | 776 |
| 68 | 124 | 1 | 59 | 60 | 94 | 95 | 731 | 732 | 787 |
| 70 | 125 | 1 | 59 | 60 | 94 | 95 | 720 | 721 | 776 |
| 71 | 126 | 1 | 76 | 77 | 105 | 106 | 730 | 731 | 786 |
| 77 | 127 | 1 | 50 | 51 | 85 | 86 | 729 | 730 | 785 |
| 78 | 128 | 1 | 48 | 49 | 83 | 84 | 729 | 730 | 784 |
| 79 | 129 | 1 | 47 | 48 | 82 | 83 | 725 | 726 | 781 |
| 80 | 130 | 1 | 50 | 51 | 85 | 86 | 747 | 748 | 804 |
| 81 | 131 | 1 | 50 | 51 | 85 | 86 | 744 | 745 | 800 |
| 87 | 132 | 1 | 53 | 54 | 88 | 89 | 727 | 728 | 784 |
| 104 | 147 | 1 | 44 | 45 | 88 | 89 | 646 | 647 | 713 |
| 106 | 149 | 1 | 46 | 47 | 77 | 78 | 715 | 716 | 777 |
| 107 | 150 | 1 | 51 | 52 | 82 | 83 | 757 | 758 | 817 |
| 108 | 151 | 1 | 50 | 51 | 81 | 82 | 754 | 755 | 813 |
| 109 | 152 | 1 | 48 | 49 | 79 | 80 | 726 | 727 | 786 |
| 112 | 153 | 1 | 49 | 50 | 80 | 81 | 720 | 721 | 782 |
| 116 | 154 | 1 | 49 | 50 | 78 | 79 | 529 | 530 | 588 |
| 119 | 155 | 1 | 47 | 48 | 89 | 90 | 707 | 708 | 766 |
| 120 | 156 | 1 | 58 | 59 | 89 | 90 | 708 | 709 | 767 |
| 121 | 157 | 1 | 59 | 60 | 91 | 92 | 710 | 711 | 769 |
| 123 | 159 | 1 | 58 | 59 | 89 | 90 | 709 | 710 | 768 |
| 127 | 163 | 1 | 49 | 50 | 80 | 81 | 733 | 734 | 796 |
| 131 | 164 | 1 | 63 | 64 | 94 | 95 | 708 | 709 | 767 |
| 132 | 165 | 1 | 51 | 52 | 82 | 83 | 743 | 744 | 806 |
| 136 | 166 | 1 | 50 | 51 | 81 | 82 | 725 | 726 | 786 |
| 138 | 167 | 1 | 63 | 64 | 94 | 95 | 747 | 748 | 809 |
| 140 | 170 | 1 | 58 | 59 | 89 | 90 | 720 | 721 | 779 |
| GROUP IV | | | | | | | | | |
| 94 | 133 | 1 | 49 | 50 | 96 | 97 | 532 | 533 | 579 |
| 97 | 134 | 1 | 41 | 42 | 88 | 89 | 470 | 471 | 517 |

TABLE 2A-continued

Amino acid positions of Cas9 ortholog domains
The Cas9 orthologs were grouped by sequence similarities with the largest variation at the REC domain. To determine the functional domain boundary, the Cas9 candidate sequences of Group I, II, III, IV, V and VI were aligned with their closest homologous sequences of known high resolution 3D structures, including PDBID: 5czz, 5czz, 4un3, 4oge, 4oge, and 5b2o, respectively. Based on these alignments, each candidate sequence was threaded into its corresponding structural template for modeling, and the domain boundaries were assigned according to the template's domain definition in the associated publication references.

| | | | | GROUP V | | | | | |
|---|---|---|---|---|---|---|---|---|---|
| 16 | 95 | 1 | 44 | 45 | 96 | 97 | 606 | 607 | 661 |
| | | | | GROUP VI | | | | | |
| 102 | 135 | 1 | 52 | 53 | 86 | 87 | 626 | 627 | 685 |

| ID# | HNH start | HNH end | RUVCIII start | RUVCIII end | WED start | WED end | PI start | PI end |
|---|---|---|---|---|---|---|---|---|
| | | | | GROUP I | | | | |
| 12 | 623 | 758 | 759 | 929 | 930 | 1035 | 1036 | 1053 |
| 18 | 559 | 681 | 682 | 824 | 825 | 925 | 926 | 1071 |
| 19 | 549 | 680 | 681 | 813 | 814 | 895 | 896 | 1044 |
| 21 | 606 | 743 | 744 | 887 | 888 | 946 | 947 | 1118 |
| 27 | 539 | 660 | 661 | 831 | 832 | 950 | 951 | 1082 |
| 28 | 535 | 656 | 657 | 804 | 805 | 925 | 926 | 1087 |
| 29 | 542 | 670 | 671 | 814 | 815 | 932 | 933 | 1074 |
| 30 | 539 | 662 | 663 | 819 | 820 | 900 | 901 | 1049 |
| 32 | 538 | 659 | 660 | 814 | 815 | 924 | 925 | 1060 |
| 33 | 536 | 655 | 656 | 823 | 824 | 938 | 839 | 1065 |
| 35 | 542 | 666 | 667 | 816 | 817 | 931 | 932 | 1069 |
| 41 | 522 | 638 | 639 | 784 | 785 | 837 | 838 | 1001 |
| 43 | 538 | 657 | 658 | 796 | 797 | 853 | 854 | 1048 |
| 44 | 571 | 697 | 698 | 863 | 864 | 981 | 982 | 1115 |
| 46 | 573 | 689 | 690 | 836 | 837 | 967 | 968 | 1137 |
| 47 | 544 | 683 | 684 | 824 | 825 | 973 | 974 | 1134 |
| 48 | 550 | 681 | 682 | 830 | 831 | 991 | 992 | 1142 |
| 50 | 543 | 677 | 678 | 822 | 823 | 966 | 967 | 1122 |
| 51 | 514 | 646 | 647 | 783 | 784 | 933 | 934 | 1091 |
| 52 | 543 | 677 | 678 | 823 | 824 | 968 | 969 | 1130 |
| 56 | 531 | 667 | 668 | 806 | 807 | 950 | 951 | 1107 |
| 60 | 531 | 662 | 663 | 799 | 800 | 926 | 927 | 1064 |
| 61 | 519 | 643 | 644 | 787 | 788 | 913 | 914 | 1063 |
| 83 | 516 | 679 | 680 | 792 | 793 | 905 | 906 | 1039 |
| 84 | 675 | 834 | 835 | 978 | 979 | 1200 | 1201 | 1354 |
| 85 | 516 | 677 | 678 | 791 | 792 | 830 | 831 | 972 |
| 88 | 503 | 662 | 663 | 788 | 789 | 899 | 900 | 1046 |
| 91 | 559 | 715 | 716 | 842 | 843 | 964 | 965 | 1094 |
| 93 | 527 | 688 | 689 | 806 | 807 | 919 | 920 | 1037 |
| 139 | 654 | 822 | *1150 | 1228 | 1229 | 1392 | 1393 | 1525 |
| 96 | 509 | 670 | 671 | 788 | 789 | 843 | 844 | 978 |
| 98 | 550 | 718 | 719 | 831 | 832 | 903 | 904 | 1037 |
| 101 | 506 | 674 | 675 | 789 | 780 | 908 | 909 | 1028 |
| 103 | 503 | 658 | 659 | 770 | 771 | 884 | 885 | 1008 |
| 105 | 572 | 735 | 736 | 846 | 847 | 997 | 998 | 1124 |
| 122 | 515 | 687 | 688 | 814 | 815 | 963 | 964 | 1136 |
| 124 | 522 | 694 | 695 | 819 | 820 | 969 | 970 | 1127 |
| 125 | 516 | 688 | 689 | 816 | 817 | 963 | 964 | 1122 |
| 126 | 516 | 688 | 689 | 813 | 814 | 964 | 965 | 1122 |
| 141 | 516 | 688 | 689 | 816 | 817 | 967 | 968 | 1130 |
| 142 | 486 | 652 | 653 | 774 | 775 | 909 | 910 | 1054 |
| | | | | GROUP II | | | | |
| 17 | 630 | 751 | 752 | 1208 | 1209 | 1322 | 1323 | 1458 |
| | | | | GROUP III | | | | |
| 2 | 693 | 852 | 853 | 1053 | 1054 | 1126 | 1127 | 1380 |
| 3 | 708 | 866 | 867 | 1014 | 1015 | 1147 | 1148 | 1403 |
| 4 | 725 | 881 | 882 | 1082 | 1083 | 1155 | 1156 | 1424 |
| 5 | 734 | 893 | 894 | 1099 | 1100 | 1172 | 1173 | 1430 |
| 6 | 756 | 962 | 963 | 1190 | 1191 | 1268 | 1269 | 1535 |
| 8 | 764 | 967 | 968 | 1189 | 1190 | 1208 | 1209 | 1440 |
| 9 | 675 | 829 | 830 | 1027 | 1028 | 1100 | 1101 | 1345 |
| 13 | 784 | 937 | 938 | 1104 | 1105 | 1167 | 1168 | 1459 |
| 63 | 775 | 930 | 931 | 1070 | 1071 | 1090 | 1091 | 1368 |
| 64 | 773 | 930 | 931 | 1112 | 1113 | 1156 | 1157 | 1375 |
| 65 | 772 | 922 | 923 | 1083 | 1084 | 1120 | 1121 | 1348 |
| 66 | 785 | 932 | 933 | 1090 | 1091 | 1127 | 1128 | 1340 |

TABLE 2A-continued

Amino acid positions of Cas9 ortholog domains
The Cas9 orthologs were grouped by sequence similarities with the largest variation at the REC domain. To determine the functional domain boundary, the Cas9 candidate sequences of Group I, II, III, IV, V and VI were aligned with their closest homologous sequences of known high resolution 3D structures, including PDBID: 5czz, 5czz, 4un3, 4oge, 4oge, and 5b2o, respectively. Based on these alignments, each candidate sequence was threaded into its corresponding structural template for modeling, and the domain boundaries were assigned according to the template's domain definition in the associated publication references.

| | | | | | | | | |
|---|---|---|---|---|---|---|---|---|
| 67 | 777 | 924 | 925 | 1078 | 1079 | 1115 | 1116 | 1330 |
| 68 | 788 | 942 | 943 | 1078 | 1079 | 1115 | 1116 | 1330 |
| 70 | 777 | 928 | 929 | 1101 | 1102 | 1138 | 1139 | 1370 |
| 71 | 787 | 937 | 938 | 1095 | 1096 | 1132 | 1133 | 1345 |
| 77 | 786 | 939 | 940 | 1081 | 1082 | 1124 | 1125 | 1365 |
| 78 | 785 | 938 | 939 | 1088 | 1089 | 1125 | 1126 | 1366 |
| 79 | 782 | 939 | 940 | 1068 | 1069 | 1103 | 1104 | 1358 |
| 80 | 805 | 967 | 968 | 1126 | 1127 | 1168 | 1169 | 1396 |
| 81 | 801 | 961 | 962 | 1096 | 1097 | 1159 | 1160 | 1395 |
| 87 | 785 | 946 | 947 | 1079 | 1080 | 1130 | 1131 | 1345 |
| 104 | 714 | 881 | 882 | 1039 | 1040 | 1253 | 1254 | 1399 |
| 106 | 778 | 941 | 942 | 1062 | 1063 | 1104 | 1105 | 1358 |
| 107 | 818 | 977 | 978 | 1124 | 1125 | 1169 | 1170 | 1384 |
| 108 | 814 | 970 | 971 | 1120 | 1121 | 1165 | 1166 | 1380 |
| 109 | 787 | 954 | 955 | 1079 | 1080 | 1129 | 1130 | 1348 |
| 112 | 783 | 941 | 942 | 1075 | 1076 | 1125 | 1126 | 1361 |
| 116 | 589 | 766 | 767 | 913 | 914 | 1102 | 1103 | 1269 |
| 119 | 767 | 930 | 931 | 1102 | 1103 | 1149 | 1150 | 1377 |
| 120 | 768 | 924 | 925 | 1096 | 1097 | 1140 | 1141 | 1371 |
| 121 | 770 | 933 | 934 | 1102 | 1103 | 1149 | 1150 | 1371 |
| 123 | 769 | 925 | 926 | 1076 | 1077 | 1123 | 1124 | 1345 |
| 127 | 797 | 963 | 964 | 1091 | 1090 | 1135 | 1136 | 1395 |
| 131 | 768 | 921 | 922 | 1065 | 1066 | 1109 | 1110 | 1318 |
| 132 | 807 | 968 | 969 | 1099 | 1100 | 1150 | 1151 | 1395 |
| 136 | 787 | 952 | 953 | 1089 | 1090 | 1149 | 1150 | 1400 |
| 138 | 810 | 979 | 980 | 1105 | 1106 | 1158 | 1159 | 1398 |
| 140 | 780 | 936 | 937 | 1081 | 1082 | 1125 | 1126 | 1337 |
| | | | | GROUP IV | | | | |
| 94 | 580 | 726 | 727 | 909 | 910 | 1025 | 1026 | 1239 |
| 97 | 518 | 672 | 673 | 820 | 821 | 913 | 914 | 1095 |
| | | | | GROUP V | | | | |
| 16 | 662 | 844 | 845 | 1000 | 1001 | 1103 | 1104 | 1442 |
| | | | | GROUP VI | | | | |
| 102 | 686 | 842 | 843 | 954 | 955 | 1184 | 1185 | 1372 |

*indicates an unstructured insertion between the HNH and RuvCIII domains.

TABLE 2B

SEQ IDs for domains of selected Cas9 orthologs

| Cas9 Ortholog ID | REC domain SEQID | RUVC1 domain SEQID | RUVC2 domain SEQID | RUVC3 domain SEQID | HNH domain SEQID | WED domain SEQID | PI domain SEQID |
|---|---|---|---|---|---|---|---|
| 2 | 1136 | 1221 | 1306 | 1391 | 1476 | 1561 | 1646 |
| 3 | 1137 | 1222 | 1307 | 1392 | 1477 | 1562 | 1647 |
| 4 | 1138 | 1223 | 1308 | 1393 | 1478 | 1563 | 1648 |
| 5 | 1139 | 1224 | 1309 | 1394 | 1479 | 1564 | 1649 |
| 6 | 1140 | 1225 | 1310 | 1395 | 1480 | 1565 | 1650 |
| 8 | 1141 | 1226 | 1311 | 1396 | 1481 | 1566 | 1651 |
| 9 | 1142 | 1227 | 1312 | 1397 | 1482 | 1567 | 1652 |
| 12 | 1143 | 1228 | 1313 | 1398 | 1483 | 1568 | 1653 |
| 13 | 1144 | 1229 | 1314 | 1399 | 1484 | 1569 | 1654 |
| 16 | 1145 | 1230 | 1315 | 1400 | 1485 | 1570 | 1655 |
| 17 | 1146 | 1231 | 1316 | 1401 | 1486 | 1571 | 1656 |
| 18 | 1147 | 1232 | 1317 | 1402 | 1487 | 1572 | 1657 |
| 19 | 1148 | 1233 | 1318 | 1403 | 1488 | 1573 | 1658 |
| 21 | 1149 | 1234 | 1319 | 1404 | 1489 | 1574 | 1659 |
| 27 | 1150 | 1235 | 1320 | 1405 | 1490 | 1575 | 1660 |
| 28 | 1151 | 1236 | 1321 | 1406 | 1491 | 1576 | 1661 |
| 29 | 1152 | 1237 | 1322 | 1407 | 1492 | 1577 | 1662 |
| 30 | 1153 | 1238 | 1323 | 1408 | 1493 | 1578 | 1663 |
| 32 | 1154 | 1239 | 1324 | 1409 | 1494 | 1579 | 1664 |
| 33 | 1155 | 1240 | 1325 | 1410 | 1495 | 1580 | 1665 |

TABLE 2B-continued

SEQ IDs for domains of selected Cas9 orthologs

| Cas9 Ortholog ID | REC domain SEQID | RUVC1 domain SEQID | RUVC2 domain SEQID | RUVC3 domain SEQID | HNH domain SEQID | WED domain SEQID | PI domain SEQID |
|---|---|---|---|---|---|---|---|
| 35 | 1156 | 1241 | 1326 | 1411 | 1496 | 1581 | 1666 |
| 41 | 1157 | 1242 | 1327 | 1412 | 1497 | 1582 | 1667 |
| 43 | 1158 | 1243 | 1328 | 1413 | 1498 | 1583 | 1668 |
| 44 | 1159 | 1244 | 1329 | 1414 | 1499 | 1584 | 1669 |
| 46 | 1160 | 1245 | 1330 | 1415 | 1500 | 1585 | 1670 |
| 47 | 1161 | 1246 | 1331 | 1416 | 1501 | 1586 | 1671 |
| 48 | 1162 | 1247 | 1332 | 1417 | 1502 | 1587 | 1672 |
| 50 | 1163 | 1248 | 1333 | 1418 | 1503 | 1588 | 1673 |
| 51 | 1164 | 1249 | 1334 | 1419 | 1504 | 1589 | 1674 |
| 52 | 1165 | 1250 | 1335 | 1420 | 1505 | 1590 | 1675 |
| 56 | 1166 | 1251 | 1336 | 1421 | 1506 | 1591 | 1676 |
| 60 | 1167 | 1252 | 1337 | 1422 | 1507 | 1592 | 1677 |
| 61 | 1168 | 1253 | 1338 | 1423 | 1508 | 1593 | 1678 |
| 63 | 1169 | 1254 | 1339 | 1424 | 1509 | 1594 | 1679 |
| 64 | 1170 | 1255 | 1340 | 1425 | 1510 | 1595 | 1680 |
| 65 | 1171 | 1256 | 1341 | 1426 | 1511 | 1596 | 1681 |
| 66 | 1172 | 1257 | 1342 | 1427 | 1512 | 1597 | 1682 |
| 67 | 1173 | 1258 | 1343 | 1428 | 1513 | 1598 | 1683 |
| 68 | 1174 | 1259 | 1344 | 1429 | 1514 | 1599 | 1684 |
| 70 | 1175 | 1260 | 1345 | 1430 | 1515 | 1600 | 1685 |
| 71 | 1176 | 1261 | 1346 | 1431 | 1516 | 1601 | 1686 |
| 77 | 1177 | 1262 | 1347 | 1432 | 1517 | 1602 | 1687 |
| 78 | 1178 | 1263 | 1348 | 1433 | 1518 | 1603 | 1688 |
| 79 | 1179 | 1264 | 1349 | 1434 | 1519 | 1604 | 1689 |
| 80 | 1180 | 1265 | 1350 | 1435 | 1520 | 1605 | 1690 |
| 81 | 1181 | 1266 | 1351 | 1436 | 1521 | 1606 | 1691 |
| 83 | 1182 | 1267 | 1352 | 1437 | 1522 | 1607 | 1692 |
| 84 | 1183 | 1268 | 1353 | 1438 | 1523 | 1608 | 1693 |
| 85 | 1184 | 1269 | 1354 | 1439 | 1524 | 1609 | 1694 |
| 87 | 1185 | 1270 | 1355 | 1440 | 1525 | 1610 | 1695 |
| 88 | 1186 | 1271 | 1356 | 1441 | 1526 | 1611 | 1696 |
| 91 | 1187 | 1272 | 1357 | 1442 | 1527 | 1612 | 1697 |
| 93 | 1188 | 1273 | 1358 | 1443 | 1528 | 1613 | 1698 |
| 94 | 1189 | 1274 | 1359 | 1444 | 1529 | 1614 | 1699 |
| 96 | 1190 | 1275 | 1360 | 1445 | 1530 | 1615 | 1700 |
| 97 | 1191 | 1276 | 1361 | 1446 | 1531 | 1616 | 1701 |
| 98 | 1192 | 1277 | 1362 | 1447 | 1532 | 1617 | 1702 |
| 101 | 1193 | 1278 | 1363 | 1448 | 1533 | 1618 | 1703 |
| 102 | 1194 | 1279 | 1364 | 1449 | 1534 | 1619 | 1704 |
| 103 | 1195 | 1280 | 1365 | 1450 | 1535 | 1620 | 1705 |
| 104 | 1196 | 1281 | 1366 | 1451 | 1536 | 1621 | 1706 |
| 105 | 1197 | 1282 | 1367 | 1452 | 1537 | 1622 | 1707 |
| 106 | 1198 | 1283 | 1368 | 1453 | 1538 | 1623 | 1708 |
| 107 | 1199 | 1284 | 1369 | 1454 | 1539 | 1624 | 1709 |
| 108 | 1200 | 1285 | 1370 | 1455 | 1540 | 1625 | 1710 |
| 109 | 1201 | 1286 | 1371 | 1456 | 1541 | 1626 | 1711 |
| 112 | 1202 | 1287 | 1372 | 1457 | 1542 | 1627 | 1712 |
| 116 | 1203 | 1288 | 1373 | 1458 | 1543 | 1628 | 1713 |
| 119 | 1204 | 1289 | 1374 | 1459 | 1544 | 1629 | 1714 |
| 120 | 1205 | 1290 | 1375 | 1460 | 1545 | 1630 | 1715 |
| 121 | 1206 | 1291 | 1376 | 1461 | 1546 | 1631 | 1716 |
| 122 | 1207 | 1292 | 1377 | 1462 | 1547 | 1632 | 1717 |
| 123 | 1208 | 1293 | 1378 | 1463 | 1548 | 1633 | 1718 |
| 124 | 1209 | 1294 | 1379 | 1464 | 1549 | 1634 | 1719 |
| 125 | 1210 | 1295 | 1380 | 1465 | 1550 | 1635 | 1720 |
| 126 | 1211 | 1296 | 1381 | 1466 | 1551 | 1636 | 1721 |
| 127 | 1212 | 1297 | 1382 | 1467 | 1552 | 1637 | 1722 |
| 131 | 1213 | 1298 | 1383 | 1468 | 1553 | 1638 | 1723 |
| 132 | 1214 | 1299 | 1384 | 1469 | 1554 | 1639 | 1724 |
| 136 | 1215 | 1300 | 1385 | 1470 | 1555 | 1640 | 1725 |
| 138 | 1216 | 1301 | 1386 | 1471 | 1556 | 1641 | 1726 |
| 139 | 1217 | 1302 | 1387 | 1472 | 1557 | 1642 | 1727 |
| 140 | 1218 | 1303 | 1388 | 1473 | 1558 | 1643 | 1728 |
| 141 | 1219 | 1304 | 1389 | 1474 | 1559 | 1644 | 1729 |
| 142 | 1220 | 1305 | 1390 | 1475 | 1560 | 1645 | 1730 |

TABLE 3

Examples of sgRNA solutions and their components (VT, crRNA repeat, loop, anti-repeat and 3' tracrRNA) for some of the Cas9 orthologs described herein As described herein, the variable targeting domain of a sgRNA can vary for example, but not limiting from at least 12 to 30 nucleotides. As described herein, the length of the loop between the crRNA and the anti-repeat can vary from at least 3 nucleotides to 100 nucleotides.

| ID# | Clade | ORF DNA SEQID | PRT SEQID | crRNA repeat SEQID | anti-repeat SEQID | 3' tracrRNA SEQID | sgRNA (CER domain) SEQID |
|---|---|---|---|---|---|---|---|
| 2 | 1 | 1 | 86 | 171 | 256 | 341 | 426 |
| 3 | 1 | 2 | 87 | 172 | 257 | 342 | 427 |
| 4 | 1 | 3 | 88 | 173 | 258 | 343 | 428 |
| 5 | 1 | 4 | 89 | 174 | 259 | 344 | 429 |
| 6 | 1 | 5 | 90 | 175 | 260 | 345 | 430 |
| 8 | 1 | 6 | 91 | 176 | 261 | 346 | 431 |
| 9 | 1 | 7 | 92 | 177 | 262 | 347 | 432 |
| 12 | 2 | 8 | 93 | 178 | 263 | 348 | 433 |
| 13 | 2 | 9 | 94 | 179 | 264 | 349 | 434 |
| 16 | 3 | 10 | 95 | 180 | 265 | 350 | 435 |
| 17 | 3 | 11 | 96 | 181 | 266 | 351 | 436 |
| 18 | 3 | 12 | 97 | 182 | 267 | 352 | 437 |
| 19 | 3 | 13 | 98 | 183 | 268 | 353 | 438 |
| 21 | 3 | 14 | 99 | 184 | 269 | 354 | 439 |
| 27 | 5 | 15 | 100 | 185 | 270 | 355 | 440 |
| 28 | 5 | 16 | 101 | 186 | 271 | 356 | 441 |
| 29 | 5 | 17 | 102 | 187 | 272 | 357 | 442 |
| 30 | 5 | 18 | 103 | 188 | 273 | 358 | 443 |
| 32 | 5 | 19 | 104 | 189 | 274 | 359 | 444 |
| 33 | 5 | 20 | 105 | 190 | 275 | 360 | 445 |
| 35 | 5 | 21 | 106 | 191 | 276 | 361 | 446 |
| 41 | 5 | 22 | 107 | 192 | 277 | 362 | 447 |
| 43 | 5 | 23 | 108 | 193 | 278 | 363 | 448 |
| 44 | 5 | 24 | 109 | 194 | 279 | 364 | 449 |
| 46 | 6 | 25 | 110 | 195 | 280 | 365 | 450 |
| 47 | 7 | 26 | 111 | 196 | 281 | 366 | 451 |
| 48 | 7 | 27 | 112 | 197 | 282 | 367 | 452 |
| 50 | 7 | 28 | 113 | 198 | 283 | 368 | 453 |
| 51 | 7 | 29 | 114 | 199 | 284 | 369 | 454 |
| 52 | 7 | 30 | 115 | 200 | 285 | 370 | 455 |
| 56 | 7 | 31 | 116 | 201 | 286 | 371 | 456 |
| 60 | 7 | 32 | 117 | 202 | 287 | 372 | 457 |
| 61 | 7 | 33 | 118 | 203 | 288 | 373 | 458 |
| 63 | 8 | 34 | 119 | 204 | 289 | 374 | 459 |
| 64 | 9 | 35 | 120 | 205 | 290 | 375 | 460 |
| 65 | 9 | 36 | 121 | 206 | 291 | 376 | 461 |
| 66 | 9 | 37 | 122 | 207 | 292 | 377 | 462 |
| 67 | 9 | 38 | 123 | 208 | 293 | 378 | 463 |
| 68 | 9 | 39 | 124 | 209 | 294 | 379 | 464 |
| 70 | 9 | 40 | 125 | 210 | 295 | 380 | 465 |
| 71 | 9 | 41 | 126 | 211 | 296 | 381 | 466 |
| 77 | 10 | 42 | 127 | 212 | 297 | 382 | 467 |
| 78 | 10 | 43 | 128 | 213 | 298 | 383 | 468 |
| 79 | 10 | 44 | 129 | 214 | 299 | 384 | 469 |
| 80 | 10 | 45 | 130 | 215 | 300 | 385 | 470 |
| 81 | 10 | 46 | 131 | 216 | 301 | 386 | 471 |
| 87 | 10 | 47 | 132 | 217 | 302 | 387 | 472 |
| 94 | 11 | 48 | 133 | 218 | 303 | 388 | 473 |
| 97 | 11 | 49 | 134 | 219 | 304 | 389 | 474 |
| 102 | 12 | 50 | 135 | 220 | 305 | 390 | 475 |
| 83 | 1 | 51 | 136 | 221 | 306 | 391 | 476 |
| 84 | 1 | 52 | 137 | 222 | 307 | 392 | 477 |
| 85 | 5 | 53 | 138 | 223 | 308 | 393 | 478 |
| 88 | 5 | 54 | 139 | 224 | 309 | 394 | 479 |
| 91 | 3 | 55 | 140 | 225 | 310 | 395 | 480 |
| 93 | 3 | 56 | 141 | 226 | 311 | 396 | 481 |
| 139 | 3 | 57 | 142 | 227 | 312 | 397 | 482 |
| 96 | 5 | 58 | 143 | 228 | 313 | 398 | 483 |
| 98 | 3 | 59 | 144 | 229 | 314 | 399 | 484 |
| 101 | 3 | 60 | 145 | 230 | 315 | 400 | 485 |
| 103 | 2 | 61 | 146 | 231 | 316 | 401 | 486 |
| 104 | 1 | 62 | 147 | 232 | 317 | 402 | 487 |
| 105 | 2 | 63 | 148 | 233 | 318 | 403 | 488 |
| 106 | 10 | 64 | 149 | 234 | 319 | 404 | 489 |
| 107 | 8 | 65 | 150 | 235 | 320 | 405 | 490 |
| 108 | 8 | 66 | 151 | 236 | 321 | 406 | 491 |
| 109 | 10 | 67 | 152 | 237 | 322 | 407 | 492 |
| 112 | 10 | 68 | 153 | 238 | 323 | 408 | 493 |
| 116 | 7 | 69 | 154 | 239 | 324 | 409 | 494 |
| 119 | 9 | 70 | 155 | 240 | 325 | 410 | 495 |
| 120 | 9 | 71 | 156 | 241 | 326 | 411 | 496 |
| 121 | 9 | 72 | 157 | 242 | 327 | 412 | 497 |
| 122 | 7 | 73 | 158 | 243 | 328 | 413 | 498 |
| 123 | 9 | 74 | 159 | 244 | 329 | 414 | 499 |
| 124 | 7 | 75 | 160 | 245 | 330 | 415 | 500 |
| 125 | 7 | 76 | 161 | 246 | 331 | 416 | 501 |
| 126 | 7 | 77 | 162 | 247 | 332 | 417 | 502 |
| 127 | 10 | 78 | 163 | 248 | 333 | 418 | 503 |
| 131 | 9 | 79 | 164 | 249 | 334 | 419 | 504 |
| 132 | 10 | 80 | 165 | 250 | 335 | 420 | 505 |
| 136 | 9 | 81 | 166 | 251 | 336 | 421 | 506 |
| 138 | 10 | 82 | 167 | 252 | 337 | 422 | 507 |
| 141 | 7 | 83 | 168 | 253 | 338 | 423 | 508 |
| 142 | 7 | 84 | 169 | 254 | 339 | 424 | 509 |
| 140 | 9 | 85 | 170 | 255 | 340 | 425 | 510 |

TABLE 4

Protospacer adjacent motif (PAM) preferences for ID2 Clade 1

Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 36.14% | 21.25% | [54.36%] | 0.16% | 0% | [91.52%] | 7.65% |
| | A | 7.44% | [78.48%] | /45.64%/ | /46.12%/ | /48.14%/ | 3.33% | 6.68% |
| | T | 24.12% | 0% | 0% | /46.68%/ | 34.78% | 3.08% | 28.66% |
| | C | 32.30% | 0.27% | 0% | 7.04% | 17.07% | 2.07% | /57.01%/ |
| Consensus | | N | A | R (G > A) | W | H (A > T > C) | G | N (C > T > R) |

TABLE 5

Protospacer adjacent motif (PAM) preferences for ID3 Clade 1
Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 28.58% | 23.58% | [55.97%] | 1.33% | 0.02% | 1.83% | 16.89% |
| | A | 10.31% | /57.81%/ | /40.56%/ | 11.2% | 2.37% | 0.26% | 24.79% |
| | T | 13.88% | 2.88% | 0% | [77.09%] | [81.69%] | [85.73%] | /42.4%/ |
| | C | /47.23%/ | 15.73% | 3.47% | 10.38% | 15.93% | 12.18% | 15.92% |
| Consensus | | N (C > D) | V (A > S) | R (G > A) | T | T | T | N (T > V) |

TABLE 6

Protospacer adjacent motif (PAM) preferences for ID4 Clade 1
Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 30.63% | 33.91% | 9.17% | 0.12% | 0.19% | 0.08% | 8.43% |
| | A | 15.52% | /53.21%/ | 20.43% | 5.77% | 4.39% | 0.43% | 6.52% |
| | T | 22.02% | 3.04% | [60.65%] | [85.47%] | [72.35%] | [90.08%] | [73.38%] |
| | C | 31.83% | 9.84% | 9.75% | 8.64% | 23.07% | 9.4% | 11.67% |
| Consensus | | N | V (A > G > C) | T | T | T | T | T |

TABLE 7

Protospacer adjacent motif (PAM) preferences for ID5 Clade 1
Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 30.31% | 31.67% | 7.44% | 0.01% | 0.01% | 0% | 4.94% |
| | A | 17.59% | [60.32%] | 19.98% | 2.08% | 1.74% | 0.09% | 4.29% |
| | T | 28.33% | 1.01% | [63.72%] | [93.23%] | [90.31%] | [97.29%] | [83.28%] |
| | C | 23.77% | 7% | 8.86% | 4.68% | 7.94% | 2.62% | 7.48% |
| Consensus | | N | A | T | T | T | T | T |

TABLE 8

Protospacer adjacent motif (PAM) preferences for ID6 Clade 1
Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 24.08% | 8.85% | 9.57% | 6.63% | 10.8% | /52.38%/ | 26.21% |
| | A | 20.44% | 33.32% | [89.83%] | [82.42%] | [61.84%] | 35.19% | 25.1% |
| | T | 18.01% | 26.95% | 0.56% | 0% | 8.44% | 5.22% | 22.01% |
| | C | 37.48% | 30.88% | 0.05% | 10.95% | 18.91% | 7.21% | 26.68% |
| Consensus | | N | N (H > G) | A | A | A | N (G > A > Y) | N |

TABLE 9

Protospacer adjacent motif (PAM) preferences for ID8 Clade 1
Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 10.17% | 6.73% | 0.89% | 1.22% | 2.56% | 3.05% | 22.15% |
| | A | 23.01% | 27.71% | [99.11%] | [98.51%] | [94.16%] | 4.91% | 37.94% |
| | T | /42.68%/ | 33.86% | 0% | 0.24% | 0.13% | [86.66%] | 26.05% |
| | C | 24.14% | 31.70% | 0% | 0.03% | 3.15% | 5.37% | 13.85% |
| Consensus | | N (T > V) | N | A | A | A | T | N |

TABLE 10

Protospacer adjacent motif (PAM) preferences for ID9 Clade 1
Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 27.23% | 12.35% | 35.91% | 5.65% | 0% | 29.72% | 31.39% |
| | A | 9.6% | [83.2%] | /48.04%/ | 19.98% | 0% | 21.22% | 9.29% |
| | T | 24.91% | 0.73% | 4.92% | [70.58%] | 0% | 12.79% | 30.15% |
| | C | 38.26% | 3.72% | 11.13% | 3.79% | [100%] | 36.27% | 29.17% |
| Consensus | | N | A | V (A > G > C) | T | C | N | N |

TABLE 11

Protospacer adjacent motif (PAM) preferences for ID12 Clade 2
Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 21.92% | 20.6% | 14.54% | 21.79% | 0% | 0% | 6.48% |
| | A | 21.26% | /46.96%/ | 26.87% | 38.08% | 0% | 0% | 8.92% |
| | T | 23.77% | 8.06% | 27.05% | 34.31% | 0% | 0% | /44.69%/ |
| | C | 33.04% | 24.38% | 31.54% | 5.82% | [100%] | [100%] | 39.92% |
| Consensus | | N | N (A > S > T) | N | N (W > G > C) | C | C | N (Y > R) |

TABLE 12

Protospacer adjacent motif (PAM) preferences for ID13 Clade 2
Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 25.31% | 23.72% | 2.93% | 3.87% | 0% | 0% | 25.89% |
| | A | 15.05% | 37.23% | [97.02%] | 24.57% | [93.86%] | 0% | 28.74% |
| | T | 30.05% | 12.64% | 0% | /45.21%/ | 3.67% | 12.01% | 23.85% |
| | C | 29.59% | 26.41% | 0.05% | 26.35% | 2.48% | [87.99%] | 21.52% |
| Consensus | | N | N | A | H (T > M) | A | C | N |

TABLE 13

Protospacer adjacent motif (PAM) preferences for ID16 Clade 3 Displayed as a position frequency matrix (PFM). Numbers in brackets [x] represent strong PAM preferences, numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 14.16% | [93.5%] | 1.83% | [85.98%] | 0.16% | 33.41% | 26.87% |
|  | A | 26.12% | 3.56% | 13.32% | 11.24% | [86.61%] | 11.29% | 23.92% |
|  | T | 24.65% | 0.3% | [64.11%] | 2.68% | 2.69% | 33.07% | 30.21% |
|  | C | 35.07% | 2.65% | 20.73% | 0.1% | 10.54% | 22.23% | 19.01% |
| Consensus |  | N | G | T | G | A | N | N |

TABLE 14

Protospacer adjacent motif (PAM) preferences for ID17 Clade 3 Displayed as a position frequency matrix (PFM). Numbers in brackets [x] represent strong PAM preferences, numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 31.01% | 1.81% | [48.09%] | 20.51% | 0.22% | 1.27% | 24.04% |
|  | A | 10.3% | [97.24%] | [51.62%] | /41.94%/ | [96.02%] | 1.54% | 35.49% |
|  | T | 37.06% | 0.42% | 0% | 29.98% | 0.04% | [92.67%] | 16.87% |
|  | C | 21.62% | 0.54% | 0.29% | 7.58% | 3.73% | 4.52% | 23.59% |
| Consensus |  | N | A | R | N (A > K > C) | A | T | N |

TABLE 15

Protospacer adjacent motif (PAM) preferences for ID18 Clade 3 Displayed as a position frequency matrix (PFM). Numbers in brackets [x] represent strong PAM preferences, numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 22.25% | /53.26%/ | [53.02%] | 22.86% | 0% | 7.32% | 23% |
|  | A | 18.57% | 35.41% | [46.92%] | 28.78% | 0.45% | 0.12% | 34.66% |
|  | T | 26.14% | 0% | 0 | 25.08% | [98.68%] | [92.53%] | 27.46% |
|  | C | 33.04% | 11.33% | 0.06 | 23.27% | 0.87% | 0.03% | 14.88% |
| Consensus |  | N | V (G > A > C) | R | N | T | T | N |

TABLE 16

Protospacer adjacent motif (PAM) preferences for ID19 Clade 3 Displayed as a position frequency matrix (PFM). Numbers in brackets [x] represent strong PAM preferences, numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 24.51% | 6.95% | /42.48%/ | 34.06% | 0% | 0% | 35.8% |
|  | A | 14.06% | /50.32%/ | /48.28%/ | /43.01%/ | 6.8% | 0% | 31.95% |
|  | T | 29.38% | 17.63% | 1% | 16.44% | 0% | 3.89% | 16.29% |
|  | C | 32.06% | 25.1% | 8.24% | 6.5% | [93.2%] | [96.11%] | 15.95% |
| Consensus |  | N | N (A > B) | R | N (A > G > T > C) | C | C | N |

TABLE 17

Protospacer adjacent motif (PAM) preferences for ID27 Clade 5
Displayed as a position frequency matrix (PFM). Numbers
in brackets [x] represent strong PAM preferences, numbers in
slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 27.54% | 12.25% | 24.63% | 11.40% | 0% | 0% | 3.11% |
| | A | 19.03% | /41.8%/ | 37.36% | 19.92% | 0% | 0% | /55.4%/ |
| | T | 20.49% | 27.98% | 24.88% | /54.55%/ | 0% | 0.30% | 23.50% |
| | C | 32.95% | 17.97% | 13.13% | 14.13% | [100%] | [99.7%] | 18% |
| Consensus | | N | N (A > B) | N | N (T > V) | C | C | H (A > Y) |

TABLE 18

Protospacer adjacent motif (PAM) preferences for ID28 Clade 5
Displayed as a position frequency matrix (PFM). Numbers
in brackets [x] represent strong PAM preferences, numbers in
slashes /x/ represent weak PAM preferences.

| | | PAM Position | | | | | | | |
|---|---|---|---|---|---|---|---|---|---|
| | | 1 | 2 | 3 | 4 | 5 | 6 | 7 | 8 |
| Nucleotide | G | 20.1% | 13.69% | 8.1% | 10.23% | 0.5% | 27.01% | 0.38% | 0.52% |
| | A | 24.09% | 26.66% | 25.49% | 29.16% | 0.1% | 32.22% | [95.74%] | [99.03%] |
| | T | 24.69% | 26.9% | 32.15% | 26.02% | 0% | 39.55% | 0.44% | 0.39% |
| | C | 31.12% | 32.76% | 34.25% | 34.59% | [99.39%] | 1.22% | 3.44% | 0.07% |
| Consensus | | N | N | N (H > G) | N | C | D | A | A |

TABLE 19

Protospacer adjacent motif (PAM) preferences for ID29 Clade 5
Displayed as a position frequency matrix (PFM). Numbers
in brackets [x] represent strong PAM preferences, numbers in
slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 20.24% | 6.48% | 32.16% | [91.37%] | [93.46%] | 24.58% | 15.75% |
| | A | 16.76% | 26.36% | /40.8%/ | 5.83% | 6.54% | 30.98% | /48.29%/ |
| | T | 24.40% | 31.57% | 25.32% | 2.70% | 0% | 39.92% | 24.16% |
| | C | 38.60% | 35.58% | 1.71% | 0.09% | 0% | 4.52% | 11.80% |
| Consensus | | N | N (H > G) | D (A > K) | G | G | D | N (A > B) |

TABLE 20

Protospacer adjacent motif (PAM) preferences for ID30 Clade 5
Displayed as a position frequency matrix (PFM). Numbers
in brackets [x] represent strong PAM preferences, numbers in
slashes /x/ represent weak PAM preferences.

| | | PAM Position | | | | | | | |
|---|---|---|---|---|---|---|---|---|---|
| | | 1 | 2 | 3 | 4 | 5 | 6 | 7 | 8 |
| Nucleotide | G | 17.53% | 11.24% | 16.65% | 15.25% | 0.00% | 0.00% | 0.00% | [97.99%] |
| | A | 21.12% | 26.13% | 29.25% | 29.16% | 30.95% | 2.88% | [100.00%] | 0.84% |
| | T | 28.26% | 30.76% | 36.33% | 33.24% | 0.00% | 3.18% | 0.00% | 0.35% |
| | C | 33.09% | 31.88% | 17.77% | 22.36% | [69.05%] | [93.94%] | 0.00% | 0.82% |
| Consensus | | N | N | N | N | C | C | A | G |

TABLE 21

Protospacer adjacent motif (PAM) preferences for ID32 Clade 5
Displayed as a position frequency matrix (PFM). Numbers
in brackets [x] represent strong PAM preferences, numbers in
slashes /x/ represent weak PAM preferences.

|  |  | PAM Position | | | | | | | |
|---|---|---|---|---|---|---|---|---|---|
|  |  | 1 | 2 | 3 | 4 | 5 | 6 | 7 | 8 |
| Nucleotide | G | 21.46% | 5.68% | 11.12% | 13.79% | 0.00% | 0.93% | 1.59% | 5.92% |
|  | A | 14.73% | 36.25% | 29.20% | 26.40% | 0.00% | 2.40% | [64.92%] | [80.85%] |
|  | T | 25.36% | 27.28% | 34.96% | 28.56% | 0.00% | [60.92%] | 33.49% | 5.07% |
|  | C | 38.45% | 30.79% | 24.71% | 31.25% | [100.00%] | 35.76% | 0.00% | 8.16% |
| Consensus |  | N | N | N | N | C | T | A | A |

TABLE 22

Protospacer adjacent motif (PAM) preferences for ID33 Clade 5
Displayed as a position frequency matrix (PFM). Numbers
in brackets [x] represent strong PAM preferences, numbers in
slashes /x/ represent weak PAM preferences.

|  |  | PAM Position | | | | | | | | | |
|---|---|---|---|---|---|---|---|---|---|---|---|
|  |  | 1 | 2 | 3 | 4 | 5 | 6 | 7 | 8 | 9 | 10 |
| Nucleotide | G | 22.09% | 7.14% | 14.13% | 11.46% | 0.00% | 29.62% | [98.54%] | 8.83% | 14.01% | 19.37% |
|  | A | 5.88% | 31.83% | 30.44% | 34.78% | 0.00% | 39.89% | 1.32% | [72.61%] | /51.42%/ | 31.58% |
|  | T | 29.82% | 32.90% | 29.77% | 22.67% | 0.00% | 0.02% | 0.14% | 13.59% | 16.89% | 26.71% |
|  | C | /42.21%/ | 28.12% | 25.67% | 31.08% | [100.00%] | 30.47% | 0.00% | 4.96% | 17.68% | 22.34% |
| Consensus |  | N | N | N | N | C | V | G | A | N | N |

TABLE 23

Protospacer adjacent motif (PAM) preferences for ID35 Clade 5
Displayed as a position frequency matrix (PFM). Numbers
in brackets [x] represent strong PAM preferences, numbers in
slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 22.03% | 9.34% | 25.15% | 17.12% | 0% | 0% | 22.47% |
|  | A | 14.56% | 39.21% | 35.63% | 9.50% | 0% | 0% | 25.37% |
|  | T | 22.33% | 24.30% | 21.03% | [71.71%] | 0% | 0% | 36.60% |
|  | C | /41.08%/ | 27.15% | 18.19% | 1.66% | [100%] | [100%] | 15.57% |
| Consensus |  | N (C > D) | N | N | T | C | C | N |

TABLE 24

Protospacer adjacent motif (PAM) preferences for ID41 Clade 5
Displayed as a position frequency matrix (PFM). Numbers
in brackets [x] represent strong PAM preferences, numbers in
slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 19.6% | 16.88% | 11.98% | 35.91% | 0.2% | 0.23% | 0.8% |
|  | A | 26.01% | 25.05% | 30.09% | 23.09% | 1.17% | 0.01% | [97.57%] |
|  | T | 25.84% | 26.95% | 35.06% | 9.22% | 0% | [97.83%] | 0.23% |
|  | C | 28.54% | 31.12% | 22.86% | 31.78% | [98.63%] | 1.93% | 1.4% |
| Consensus |  | N | N | N | N | C | T | A |

TABLE 25

Protospacer adjacent motif (PAM) preferences for ID44 Clade 5
Displayed as a position frequency matrix (PFM). Numbers
in brackets [x] represent strong PAM preferences, numbers in
slashes /x/ represent weak PAM preferences.

|  |  | PAM Position | | | | | | | |
|---|---|---|---|---|---|---|---|---|---|
|  |  | 1 | 2 | 3 | 4 | 5 | 6 | 7 | 8 |
| Nucleotide | G | 19.80% | 7.57% | 11.08% | 15.61% | [98.54%] | 0.00% | 0.00% | 0.16% |
|  | A | 17.69% | 38.78% | 29.27% | 22.89% | 1.46% | 0.00% | [93.02%] | [98.91%] |
|  | T | 23.27% | 23.76% | 27.37% | 30.29% | 0.00% | [45.31%] | 6.98% | 0.83% |
|  | C | 39.24% | 29.90% | 32.27% | 31.22% | 0.00% | [54.69%] | 0.00% | 0.10% |
| Consensus |  | N | N | N | N | C | Y | A | A |

TABLE 26

Protospacer adjacent motif (PAM) preferences for ID46 Clade 6
Displayed as a position frequency matrix (PFM). Numbers
in brackets [x] represent strong PAM preferences, numbers in
slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 26.51% | 25.76% | [97.21%] | [37.66%] | [73.44%] | 28.66% | 8.28% |
|  | A | 16.02% | [70.60%] | 2.08% | [44.79%] | 16.96% | 24.92% | 2.22% |
|  | T | 12.28% | 0.00% | 0.01% | 0.60% | 8.66% | 31.22% | [47.73%] |
|  | C | /45.19%/ | 3.64% | 0.70% | 16.96% | 0.94% | 15.20% | [41.77%] |
| Consensus |  | N | A | G | R | G | N | Y |

TABLE 27

Protospacer adjacent motif (PAM) preferences for ID47 Clade 7
Displayed as a position frequency matrix (PFM). Numbers in brackets
[x] represent strong PAM preferences, numbers in slashes
/x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 21.09% | 14.51% | [96.97%] | 1.68% | 0.47% | 1.22% | 6.41% |
|  | A | 21.36% | 31.40% | 2.71% | /46.42%/ | [91.5%] | [98.06%] | [80.67%] |
|  | T | 25.16% | 29.52% | 0.13% | /39.18%/ | 0.91% | 0.56% | 7.71% |
|  | C | 32.39% | 24.57% | 0.19% | 12.72% | 7.12% | 0.16% | 5.21% |
| Consensus |  | N | N | G | H (W > C) | A | A | A |

TABLE 28

Protospacer adjacent motif (PAM) preferences for ID48 Clade 7
Displayed as a position frequency matrix (PFM). Numbers in brackets
[x] represent strong PAM preferences, numbers in slashes
/x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 25.12% | 13.23% | [96.52%] | 2.72% | 1.12% | 2.51% | 27.13% |
|  | A | 19.76% | 37.09% | 1.57% | [95.9%] | [90.8%] | [95.87%] | 31.21% |
|  | T | 27.23% | 32.68% | 1.52% | 0.02% | 0.04% | 0.52% | 22.90% |
|  | C | 27.89% | 17% | 0.39% | 1.36% | 8.04% | 1.11% | 18.75% |
| Consensus |  | N | N | G | A | A | A | N |

TABLE 29

Protospacer adjacent motif (PAM) preferences for ID50 Clade 7
Displayed as a position frequency matrix (PFM). Numbers in brackets
[x] represent strong PAM preferences, numbers in slashes
/x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 18.16% | 9.71% | 2.12% | 1.86% | 0.48% | 0.87% | 19.56% |
|  | A | 15.19% | 25.57% | [97.47%] | [97.38%] | [98.98%] | [98.68%] | [61.85%] |
|  | T | 36.44% | 35.35% | 0.03% | 0% | 0% | 0.13% | 11.97% |
|  | C | 30.21% | 29.37% | 0.38% | 0.76% | 0.54% | 0.32% | 6.62% |
| Consensus |  | N | N | A | A | A | A | A |

TABLE 30

Protospacer adjacent motif (PAM) preferences for ID51 Clade 7
Displayed as a position frequency matrix (PFM). Numbers in brackets
[x] represent strong PAM preferences, numbers in slashes
/x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 23.52% | 1.72% | [99.37%] | 9.50% | /39.07%/ | 5.89% | 7.91% |
|  | A | 21.33% | 6.50% | 0.58% | [89.72%] | [59.06%] | /45.26%/ | 9.79% |
|  | T | 25.10% | [65.77%] | 0.01% | 0% | 1.05% | 23.46% | /39.29%/ |
|  | C | 30.05% | 26.02% | 0.04% | 0.78% | 0.82% | 25.40% | /43.01%/ |
| Consensus |  | N | T | G | A | R (G > A) | N (A > Y > G) | N (Y > R) |

TABLE 31

Protospacer adjacent motif (PAM) preferences for ID52 Clade 7
Displayed as a position frequency matrix (PFM). Numbers in brackets
[x] represent strong PAM preferences, numbers in slashes
/x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 18.00% | 4.92% | [87.99%] | 1.61% | 18.62% | 13.60% | 12.07% |
|  | A | 20.27% | 34.84% | 11.02% | 6.15% | /53.71%/ | [69.84%] | /52.19%/ |
|  | T | 18.20% | 20.00% | 0.00% | /55.44%/ | 13.96% | 12.71% | 21.31% |
|  | C | /43.53%/ | /40.24%/ | 0.99% | 36.80% | 13.72% | 3.85% | 14.44% |
| Consensus |  | N (C > D) | H (C > W) | G | H (Y > A) | N(A > B) | A | N(A > T > S) |

TABLE 32

Protospacer adjacent motif (PAM) preferences for ID56 Clade 7
Displayed as a position frequency matrix (PFM).
Numbers in brackets [x] represent strong PAM preferences,
numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 18.78% | 15.33% | 4.88% | 11.14% | 18.77% | 0.21% | 20.14% |
|  | A | 23.55% | 25.44% | [91.9%] | [82.72%] | [76.54%] | 8.37% | 33.96% |
|  | T | 27.99% | 29.19% | 0.46% | 0.26% | 0% | 2.49% | 24.76% |
|  | C | 29.68% | 30.04% | 2.77% | 5.89% | 4.69% | [88.93%] | 21.15% |
| Consensus |  | N | N | A | A | A | C | N |

TABLE 33

Protospacer adjacent motif (PAM) preferences for ID60 Clade 7
Displayed as a position frequency matrix (PFM).
Numbers in brackets [x] represent strong PAM preferences,
numbers in slashes /x/ represent weak PAM preferences.

| | | \multicolumn{7}{c}{PAM Position} | | | | | | |
|---|---|---|---|---|---|---|---|---|
| | | 1 | 2 | 3 | 4 | 5 | 6 | 7 |
| Nucleotide | G | 24.17% | 15.28% | [97.1%] | 0.41% | 0.09% | 0.18% | 4.03% |
| | A | 29.63% | 27.87% | 2.34% | 7.16% | [96.54%] | [55.4%] | 3.18% |
| | T | 19.14% | 31.83% | 0.31% | [80.64%] | 0.09% | 2.32% | [47.41%] |
| | C | 27.07% | 25.02% | 0.25% | 11.79% | 3.28% | /42.09%/ | [45.38%] |
| Consensus | | N | N | G | T | A | M (A > C) | Y |

TABLE 34

Protospacer adjacent motif (PAM) preferences for ID61 Clade 7
Displayed as a position frequency matrix (PFM).
Numbers in brackets [x] represent strong PAM preferences,
numbers in slashes /x/ represent weak PAM preferences.

| | | \multicolumn{7}{c}{PAM Position} | | | | | | |
|---|---|---|---|---|---|---|---|---|
| | | 1 | 2 | 3 | 4 | 5 | 6 | 7 |
| Nucleotide | G | 16.33% | 2.30% | 10.45% | [49.71%] | 10.27% | 5.21% | 15.67% |
| | A | 22.71% | /40.64%/ | [82.63%] | [48.82%] | 31.37% | 24.51% | 24.47% |
| | T | 24.79% | 27.85% | 1.16% | 0.10% | 20.68% | 18.23% | 26.59% |
| | C | 36.17% | 29.22% | 5.76% | 1.37% | 37.68% | /52.04%/ | 33.27% |
| Consensus | | N | H (A > Y) | A | R | N | N (C > W > G) | N |

TABLE 35

Protospacer adjacent motif (PAM) preferences for ID63 Clade 8
Displayed as a position frequency matrix (PFM).
Numbers in brackets [x] represent strong PAM preferences,
numbers in slashes /x/ represent weak PAM preferences.

| | | \multicolumn{7}{c}{PAM Position} | | | | | | |
|---|---|---|---|---|---|---|---|---|
| | | 1 | 2 | 3 | 4 | 5 | 6 | 7 |
| Nucleotide | G | 18.02% | [100.00%] | [100.00%] | 5.80% | 13.04% | 11.96% | 23.28% |
| | A | 1.58% | 0.00% | 0.00% | /44.96%/ | 33.20% | 37.33% | 28.59% |
| | T | 16.39% | 0.00% | 0.00% | 26.50% | /42.62%/ | 23.30% | 26.37% |
| | C | [64.01%] | 0.00% | 0.00% | 22.73% | 11.14% | 27.41% | 21.77% |
| Consensus | | B (C > K) | G | G | N(A > Y > G) | N | N | N |

TABLE 36

Protospacer adjacent motif (PAM) preferences for ID64 Clade 9
Displayed as a position frequency matrix (PFM).
Numbers in brackets [x] represent strong PAM preferences,
numbers in slashes /x/ represent weak PAM preferences.

| | | \multicolumn{7}{c}{PAM Position} | | | | | | |
|---|---|---|---|---|---|---|---|---|
| | | 1 | 2 | 3 | 4 | 5 | 6 | 7 |
| Nucleotide | G | 12.01% | 0% | [100%] | 0.07% | 19.95% | 26.33% | 24.20% |
| | A | P11 8.86% | [99.63%] | 0% | [94.81%] | /50.21%/ | 29.24% | 25.36% |
| | T | /48.83%/ | 0.37% | 0% | 3.02% | 24.39% | 34.46% | 24.57% |
| | C | 30.30% | 0% | 0% | 2.11% | 5.45% | 9.97% | 25.87% |
| Consensus | | N (T > C > R) | A | G | A | N (A > K > C) | N | N |

TABLE 37

Protospacer adjacent motif (PAM) preferences for ID65 Clade 9
Displayed as a position frequency matrix (PFM).
Numbers in brackets [x] represent strong PAM preferences,
numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 29.95% | [98.81%] | [100%] | 20.33% | 11.57% | 20.52% | 21.23% |
| | A | 22.13% | 1.11% | 0% | /40.36%/ | 28.8% | 25.49% | 21.63% |
| | T | 23.24% | 0% | 0% | 32.01% | 39.99% | 27.35% | 28.24% |
| | C | 24.68% | 0.08% | 0% | 7.31% | 19.64% | 26.64% | 28.91% |
| Consensus | | N | G | G | N (A > T > G > C) | N | N | N |

TABLE 38

Protospacer adjacent motif (PAM) preferences for ID66 Clade 9
Displayed as a position frequency matrix (PFM).
Numbers in brackets [x] represent strong PAM preferences,
numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 29.95% | [100.00%] | [100.00%] | 8.51% | 3.40% | 24.99% | 26.27% |
| | A | 9.78% | 0.00% | 0.00% | /50.57%/ | 20.08% | 30.56% | 20.09% |
| | T | /42.89%/ | 0.00% | 0.00% | 38.92% | [62.19%] | 20.92% | 25.07% |
| | C | 17.38% | 0.00% | 0.00% | 2.01% | 14.32% | 23.53% | 28.56% |
| Consensus | | N | G | G | D (A > T > G) | T | N | N |

TABLE 39

Protospacer adjacent motif (PAM) preferences for ID67 Clade 9
Displayed as a position frequency matrix (PFM).
Numbers in brackets [x] represent strong PAM preferences,
numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | /42.62%/ | [100.00%] | [100.00%] | 4.86% | 5.70% | 18.40% | 25.58% |
| | A | 9.95% | 0.00% | 0.00% | [60.99%] | 25.61% | /40.20%/ | 26.75% |
| | T | 30.10% | 0.00% | 0.00% | 30.95% | /54.61%/ | 19.59% | 22.24% |
| | C | 17.33% | 0.00% | 0.00% | 3.20% | 14.08% | 21.81% | 25.42% |
| Consensus | | N | G | G | A | N (T > A > C > G) | N | N |

TABLE 40

Protospacer adjacent motif (PAM) preferences for ID68 Clade 9
Displayed as a position frequency matrix (PFM).
Numbers in brackets [x] represent strong PAM preferences,
numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 14.54% | [100.00%] | [100.00%] | 4.29% | 28.33% | 26.60% | 19.02% |
| | A | [74.70%] | 0.00% | 0.00% | [41.25%] | 22.57% | 18.82% | 23.93% |
| | T | 5.28% | 0.00% | 0.00% | [50.74%] | /42.19%/ | 26.56% | 33.25% |
| | C | 5.47% | 0.00% | 0.00% | 3.72% | 6.91% | 28.02% | 23.80% |
| Consensus | | C | G | G | W | N (T > R > C) | N | N |

TABLE 41

Protospacer adjacent motif (PAM) preferences for ID70 Clade 9
Displayed as a position frequency matrix (PFM).
Numbers in brackets [x] represent strong PAM preferences,
numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 24.91% | [99.98%] | [100.00%] | 5.34% | [94.33%] | 19.93% | 29.84% |
|  | A | 26.13% | 0.02% | 0.00% | [46.68%] | 1.55% | 23.48% | 30.32% |
|  | T | 18.33% | 0.00% | 0.00% | [40.21%] | 4.09% | 37.54% | 28.07% |
|  | C | 30.63% | 0.00% | 0.00% | 7.78% | 0.04% | 19.05% | 11.76% |
| Consensus |  | N | G | G | W | G | N | N |

TABLE 42

Protospacer adjacent motif (PAM) preferences for ID71 Clade 9
Displayed as a position frequency matrix (PFM). Numbers in
brackets [x] represent strong PAM preferences, numbers
in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 33.94% | [96.51%] | [100%] | 21.22% | 10.39% | 17.04% | 21.07% |
|  | A | 8.38% | 3.38% | 0% | 38.2% | 21.19% | 25.41% | 19.39% |
|  | T | 24.58% | 0.02% | 0% | 30% | /45.92%/ | 28.63% | 27.51% |
|  | C | 33.09% | 0.09% | 0% | 10.57% | 22.5% | 28.92% | 32.03% |
| Consensus |  | N (B > A) | G | G | N | N (T > V) | N | N |

TABLE 43

Protospacer adjacent motif (PAM) preferences for ID77 Clade 10
Displayed as a position frequency matrix (PFM). Numbers in
brackets [x] represent strong PAM preferences, numbers
in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 20.44% | 16.02% | [100%] | 5.88% | 0.49% | 0.4% | 34.54% |
|  | A | 22.94% | 33.83% | 0% | /50.41%/ | [97.92%] | 0.01% | 16.29% |
|  | T | 17.07% | 16.73% | 0% | /39.08%/ | 1.45% | [58.62%] | 33.89% |
|  | C | 39.56% | 33.41% | 0% | 4.63% | 0.14% | /40.98%/ | 15.27% |
| Consensus |  | N | N | G | D (A > T > G) | A | Y (T > C) | N |

TABLE 44

Protospacer adjacent motif (PAM) preferences for ID78 Clade 10
Displayed as a position frequency matrix (PFM). Numbers in
brackets [x] represent strong PAM preferences, numbers
in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 10.68% | 2.39% | 15.41% | 0% | 3.57% | 9.44% | 22.67% |
|  | A | 23.8% | 16.85% | [84.22%] | [99.64%] | [93.98%] | [70.52%] | 29.29% |
|  | T | /44.87%/ | /51.64%/ | 0.03% | 0% | 0.99% | 14.92% | 29.54% |
|  | C | 20.65% | 29.11% | 0.34% | 0.36% | 1.46% | 5.12% | 18.5% |
| Consensus |  | N (T > V) | H(T > C > A) | A | A | A | A | N |

TABLE 45

Protospacer adjacent motif (PAM) preferences for ID79 Clade 10 Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 17.96% | [49.6%] | 0.33% | 0.12% | 23.37% | 14.15% | 25.08% |
| | A | 19.51% | [50.11%] | 0% | [99.66%] | [67.06%] | 30.69% | 24.04% |
| | T | 39.37% | 0.03% | [99.45%] | 0% | 0.49% | 39.64% | 32.45% |
| | C | 23.16% | 0.26% | 0.22% | 0.22% | 9.08% | 15.51% | 18.43% |
| Consensus | | N | R | T | A | A | N | N |

TABLE 46

Protospacer adjacent motif (PAM) preferences for ID80 Clade 10 Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 8.42% | 0.03% | 0.44% | 0.06% | 4.62% | 15.47% | 29.89% |
| | A | 33.01% | 0.61% | [99.2%] | [98.11%] | 17.78% | 6.43% | 23.57% |
| | T | 30.66% | 8.58% | 0% | 0.26% | 35.06% | 38.25% | 24.99% |
| | C | 27.91% | [90.78%] | 0.35% | 1.57% | /42.53%/ | 39.84% | 21.55% |
| Consensus | | N (H > G) | C | A | A | H (Y > A) | N (Y > R) | N |

TABLE 47

Protospacer adjacent motif (PAM) preferences for ID81 Clade 10 Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 29.96% | 27.29% | 0.34% | 1.38% | 2.24% | 11.3% | 22.57% |
| | A | 14.59% | [65.08%] | 1.88% | [97.76%] | [67.48%] | /48.92%/ | 35.93% |
| | T | 27.33% | 0% | [88.08%] | 0% | 28.63% | 30.55% | 23.15% |
| | C | 28.12% | 7.63% | 9.7% | 0.86% | 1.66% | 9.23% | 18.35% |
| Consensus | | N | A | T | A | A | N (A > T > S) | N |

TABLE 48

Protospacer adjacent motif (PAM) preferences for ID87 Clade 10 Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 25.83% | 31.80% | 38.79% | 12.23% | 0.08% | 0% | 20.01% |
| | A | 25.90% | /50.88%/ | /55.74%/ | [87.6%] | 2.01% | 3.30% | 30.63% |
| | T | 25.64% | 4.20% | 3.18% | 0% | 6.79% | 25.75% | 26.88% |
| | C | 22.64% | 13.12% | 2.29% | 0.18% | [91.12%] | [70.96%] | 22.49% |
| Consensus | | N | V (A > G > C) | R (A > G) | A | C | C | N |

TABLE 49

Protospacer adjacent motif (PAM) preferences for ID94 Clade 11
Displayed as a position frequency matrix (PFM). Numbers in
brackets [x] represent strong PAM preferences, numbers
in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 13.46% | 6.70% | 13.39% | 28.71% | [99.1%] | 25.66% | 0% |
| | A | 3.38% | 24.93% | [59.5%] | /48.9%/ | 0.90% | [69.36%] | 0% |
| | T | 22.26% | 25.44% | 16.06% | 4.46% | 0% | 2.51% | 33.08% |
| | C | [60.9%] | /42.94%/ | 11.05% | 17.93% | 0% | 2.46% | [66.92%] |
| Consensus | | C | N (C > W > G) | A | V (A > S) | G | A | C |

TABLE 50

Protospacer adjacent motif (PAM) preferences for ID97 Clade 11
Displayed as a position frequency matrix (PFM). Numbers in
brackets [x] represent strong PAM preferences, numbers
in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 19.77% | 7.13% | /49.18%/ | 19.04% | 0% | 0.55% | 0.51% |
| | A | 15.06% | 31.96% | /50.58%/ | 39.67% | 0.51% | [82.96%] | 0.16% |
| | T | 29.42% | 26.91% | 0.04% | 23.74% | 14.81% | 3.03% | 38.27% |
| | C | 35.75% | 33.99% | 0.20% | 17.55% | [84.68%] | 13.46% | [61.06%] |
| Consensus | | N | N | R | N | C | A | C |

TABLE 51

Protospacer adjacent motif (PAM) preferences for ID102 Clade 12
Displayed as a position frequency matrix (PFM). Numbers in
brackets [x] represent strong PAM preferences, numbers
in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 16.73% | [99.91%] | [100.00%] | 13.17% | /43.25%/ | 23.63% | 18.92% |
| | A | /55.36%/ | 0.09% | 0.00% | [36.82%] | 23.17% | 28.78% | 33.64% |
| | T | 16.66% | 0.00% | 0.00% | [46.75%] | 29.00% | 23.22% | 29.38% |
| | C | 11.26% | 0.00% | 0.00% | 3.26% | 4.58% | 24.37% | 18.06% |
| Consensus | | N(A > B) | G | G | D (W > G) | D (G > W) | N | N |

TABLE 52

Protospacer adjacent motif (PAM) preferences for ID83 Clade 1
Displayed as a position frequency matrix (PFM). Numbers in
brackets [x] represent strong PAM preferences, numbers
in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 21.29% | [69.99%] | /55.33%/ | [96.57%] | 3.91% | 0.03% | 27.00% |
| | A | 4.07% | 30.01% | 26.95% | 3.43% | 11.82% | 0.09% | /42.82%/ |
| | T | 36.48% | 0.00% | 16.30% | 0.00% | [78.79%] | 0.36% | 24.52% |
| | C | 38.16% | 0.00% | 1.42% | 0.00% | 5.47% | [99.52%] | 5.66% |
| Consensus | | B | G | D (G > W) | G | T | C | N(A > K > C) |

TABLE 53

Protospacer adjacent motif (PAM) preferences for ID84 Clade 1 Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 26.80% | 23.57% | 28.47% | 9.76% | 29.69% | 0.00% | 22.61% |
| | A | 17.55% | [68.75%] | [71.16%] | /46.84%/ | [70.25%] | 0.00% | 36.36% |
| | T | 25.16% | 0.05% | 0.00% | 30.92% | 0.00% | 0.00% | 17.25% |
| | C | 30.49% | 7.63% | 0.36% | 12.47% | 0.06% | [100.00%] | 23.78% |
| Consensus | | N | A | A | N | A | C | N |

TABLE 54

Protospacer adjacent motif (PAM) preferences for ID85 Clade 5 Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 17.42% | [53.62%] | 4.73% | 0.45% | 2.01% | 18.15% | 15.99% |
| | A | 30.45% | [43.97%] | 0.06% | /49.54%/ | [92.82%] | /53.05%/ | 36.07% |
| | T | 30.96% | 1.11% | [92.25%] | 31.86% | 4.44% | 16.94% | 29.85% |
| | C | 21.16% | 1.30% | 2.96% | 18.15% | 0.73% | 11.85% | 18.09% |
| Consensus | | N | R | T | H | A | N(A > B) | N |

TABLE 55

Protospacer adjacent motif (PAM) preferences for ID88 Clade 5 Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 15.23% | 3.65% | 6.39% | 28.21% | [100.00%] | 10.46% | 3.68% |
| | A | 1.33% | 35.26% | 34.29% | 22.17% | 0.00% | 19.54% | 16.19% |
| | T | 31.94% | 23.85% | 24.91% | 35.52% | 0.00% | /48.96%/ | 37.01% |
| | C | /51.50%/ | 37.23% | 34.40% | 14.10% | 0.00% | 21.04% | /43.11%/ |
| Consensus | | B | H | N (H > G) | N | G | N(T > M) | H(Y > A) |

TABLE 56

Protospacer adjacent motif (PAM) preferences for ID91 Clade 3 Displayed as a position frequency matrix (PFM). Numbers in brackets [x] represent strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 17.45% | 9.96% | [47.08%] | 12.89% | 0.08% | 3.20% | 15.05% |
| | A | 18.82% | [48.84%] | [48.45%] | /42.75%/ | [90.63%] | 10.35% | 28.37% |
| | T | 23.00% | 1.78% | 0.00% | 21.97% | 1.91% | 33.16% | 28.30% |
| | C | /40.72%/ | [39.42%] | 4.47% | 22.39% | 7.38% | /53.30%/ | 28.28% |
| Consensus | | N | M | R | N(A > Y > G) | A | H(C > T > A) | N |

TABLE 57

Protospacer adjacent motif (PAM) preferences for ID93 Clade 3
Displayed as a position frequency matrix (PFM). Numbers in brackets [x] represent
strong PAM preferences, numbers in slashes /x/ represent weak PAM preferences.

|  |  | \multicolumn{7}{c}{PAM Position} |
|---|---|---|---|---|---|---|---|---|
|  |  | 1 | 2 | 3 | 4 | 5 | 6 | 7 |
| Nucleotide | G | 25.77% | 12.84% | 17.81% | 0.00% | 0.01% | 0.00% | 32.43% |
|  | A | 13.74% | 33.00% | 26.81% | 5.22% | [96.69%] | 0.01% | 28.00% |
|  | T | 23.55% | 27.15% | 31.60% | 7.76% | 2.97% | 0.00% | 21.13% |
|  | C | 36.95% | 27.01% | 23.78% | [87.03%] | 0.33% | [99.99%] | 18.44% |
| Consensus |  | N | N | N | C | A | C | N |

TABLE 58

Protospacer adjacent motif (PAM) preferences for ID94 Clade 3
Displayed as a position frequency matrix (PFM). Numbers in brackets [x] represent
strong PAM preferences, numbers in slashes /x/ represent weak PAM preferences.

|  |  | \multicolumn{7}{c}{PAM Position} |
|---|---|---|---|---|---|---|---|---|
|  |  | 1 | 2 | 3 | 4 | 5 | 6 | 7 |
| Nucleotide | G | 33.90% | 3.24% | [40.55%] | 10.77% | 0.40% | 0.01% | 35.20% |
|  | A | 24.40% | [96.24%] | [56.77%] | 32.74% | [92.08%] | 1.03% | 24.78% |
|  | T | 19.50% | 0.30% | 0.10% | /47.78%/ | 0.33% | 0.13% | 17.92% |
|  | C | 22.20% | 0.22% | 2.59% | 8.71% | 7.19% | [98.83%] | 22.10% |
| Consensus |  | N | A | R | N(T > A > S) | A | C | N |

TABLE 59

Protospacer adjacent motif (PAM) preferences for ID96 Clade 5
Displayed as a position frequency matrix (PFM). Numbers in brackets [x] represent
strong PAM preferences, numbers in slashes /x/ represent weak PAM preferences.

|  |  | \multicolumn{7}{c}{PAM Position} |
|---|---|---|---|---|---|---|---|---|
|  |  | 1 | 2 | 3 | 4 | 5 | 6 | 7 |
| Nucleotide | G | 24.38% | 17.48% | 26.35% | 30.52% | 0.04% | 0.00% | 0.29% |
|  | A | 22.39% | 27.59% | 34.39% | 23.04% | [99.96%] | 0.00% | [55.85%] |
|  | T | 30.35% | 32.34% | 21.12% | 32.84% | 0.00% | [89.28%] | [43.70%] |
|  | C | 22.89% | 22.59% | 18.14% | 13.60% | 0.00% | 10.72% | 0.17% |
| Consensus |  | N | N | N | N | A | T | W |

TABLE 60

Protospacer adjacent motif (PAM) preferences for ID98 Clade 3
Displayed as a position frequency matrix (PFM). Numbers in brackets [x] represent
strong PAM preferences, numbers in slashes /x/ represent weak PAM preferences.

|  |  | \multicolumn{7}{c}{PAM Position} |
|---|---|---|---|---|---|---|---|---|
|  |  | 1 | 2 | 3 | 4 | 5 | 6 | 7 |
| Nucleotide | G | 8.87% | [89.17%] | 1.36% | 21.49% | [84.56%] | 0.17% | 32.45% |
|  | A | 21.23% | 7.29% | 1.95% | 24.66% | 3.76% | 3.87% | /40.20%/ |
|  | T | 28.78% | 0.01% | 9.16% | 15.83% | 9.76% | 7.63% | 12.82% |
|  | C | 41.12% | 3.53% | [87.53%] | 38.01% | 1.92% | [88.33%] | 14.54% |
| Consensus |  | N | G | C | N | G | C | N |

TABLE 61

Protospacer adjacent motif (PAM) preferences for ID101 Clade 3
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 20.01% | 11.34% | 23.82% | 0.00% | 0.00% | 0.00% | 20.18% |
| | A | 20.55% | 26.03% | 24.66% | 12.82% | [98.81%] | 8.54% | 35.07% |
| | T | 19.48% | 23.24% | 32.59% | 0.45% | 1.00% | [91.33%] | 26.49% |
| | C | 39.96% | 39.39% | 18.94% | [86.73%] | 0.19% | 0.13% | 18.26% |
| Consensus | | N | N | N | C | A | T | N |

TABLE 62

Protospacer adjacent motif (PAM) preferences for ID103 Clade 2
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 16.15% | 18.90% | [65.15%] | 31.12% | [75.29%] | 0.00% | 14.10% |
| | A | 32.93% | [74.24%] | 34.60% | 35.43% | 24.71% | 2.54% | 26.89% |
| | T | 22.28% | 0.00% | 0.00% | 17.78% | 0.00% | 0.00% | 32.85% |
| | C | 28.64% | 6.86% | 0.25% | 15.67% | 0.00% | [97.46%] | 26.16% |
| Consensus | | N | A | G | N | G | C | N |

TABLE 63

Protospacer adjacent motif (PAM) preferences for ID104 Clade 1
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 26.47% | 23.57% | [49.94%] | 5.78% | 0.00% | 0.00% | 32.11% |
| | A | 21.51% | [64.48%] | [47.51%] | 19.40% | 1.31% | 1.41% | 28.90% |
| | T | 20.60% | 0.07% | 1.15% | /43.06%/ | 0.00% | 1.64% | 20.22% |
| | C | 31.41% | 11.88% | 1.39% | 31.76% | [98.69%] | [96.95%] | 18.77% |
| Consensus | | N | A | R | N(T > M > G) | C | C | N |

TABLE 64

Protospacer adjacent motif (PAM) preferences for ID105 Clade 2
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 26.70% | 11.24% | 3.62% | 0.48% | 0.00% | 5.98% | 25.19% |
| | A | 25.30% | [60.72%] | 14.33% | 10.21% | 2.18% | 0.15% | 22.86% |
| | T | 23.50% | 22.59% | [64.96%] | 8.66% | 0.00% | [81.78%] | 16.31% |
| | C | 24.51% | 5.45% | 17.09% | [80.65%] | [97.82%] | 12.09% | 35.64% |
| Consensus | | N | A | T | C | C | T | N |

TABLE 65

Protospacer adjacent motif (PAM) preferences for ID106 Clade 6
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 19.69% | [46.70%] | 0.00% | 0.00% | 24.29% | 11.63% | 24.06% |
| | A | 16.38% | [53.30%] | 0.00% | [100.00%] | [71.30%] | 29.64% | 23.15% |
| | T | 38.91% | 0.00% | [100.00%] | 0.00% | 0.00% | /46.72%/ | 33.44% |
| | C | 25.02% | 0.00% | 0.00% | 0.00% | 4.41% | 12.01% | 19.35% |
| Consensus | | N | R | T | A | A | N(T > A > S) | N |

TABLE 66

Protospacer adjacent motif (PAM) preferences for ID107 Clade 8
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 19.44% | 0.54% | 1.45% | 32.87% | 0.50% | 13.62% | 20.21% |
| | A | 7.49% | [98.74%] | [98.05%] | /58.52%/ | 14.45% | 33.94% | 20.81% |
| | T | 32.50% | 0.18% | 0.00% | 8.48% | 3.05% | 31.30% | 34.38% |
| | C | /40.56%/ | 0.54% | 0.50% | 0.13% | [81.99%] | 21.14% | 24.59% |
| Consensus | | N(C > T > G > A) | A | A | D (A > G > T) | C | N | N |

TABLE 67

Protospacer adjacent motif (PAM) preferences for ID108 Clade 8
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 12.41% | 5.35% | 0.46% | 21.00% | [75.85%] | 28.22% | 19.32% |
| | A | 13.28% | [87.06%] | [99.54%] | [79.00%] | 20.68% | 29.04% | 30.07% |
| | T | 37.38% | 1.04% | 0.00% | 0.00% | 2.60% | 29.23% | 33.21% |
| | C | 36.93% | 6.54% | 0.00% | 0.00% | 0.87% | 13.51% | 17.40% |
| Consensus | | N | A | A | A | G | N | N |

TABLE 68

Protospacer adjacent motif (PAM) preferences for ID109 Clade 10
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 19.23% | 24.61% | [99.54%] | 0.00% | 0.00% | 16.90% | 32.02% |
| | A | 24.52% | 38.19% | 0.46% | [91.30%] | 2.36% | 28.36% | 27.48% |
| | T | 25.09% | 23.78% | 0.00% | 0.00% | 6.53% | 35.06% | 24.12% |
| | C | 31.16% | 13.42% | 0.00% | 8.70% | [91.11%] | 19.68% | 16.37% |
| Consensus | | N | N | G | A | C | N | N |

TABLE 69

Protospacer adjacent motif (PAM) preferences for ID112 Clade 10
Displayed as a position frequency matrix (PFM). Numbers in brackets [x] represent
strong PAM preferences, numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 16.33% | 14.11% | 0.00% | 0.00% | 2.17% | 8.84% | 25.79% |
|  | A | 19.13% | 25.38% | 6.25% | [100.00%] | [97.22%] | /54.51%/ | 23.51% |
|  | T | /42.09%/ | 38.68% | [93.65%] | 0.00% | 0.61% | 34.03% | 34.56% |
|  | C | 22.44% | 21.83% | 0.09% | 0.00% | 0.00% | 2.61% | 16.13% |
| Consensus |  | N(T > V) | N | T | A | A | D (A > T > G) | N |

TABLE 70

Protospacer adjacent motif (PAM) preferences for ID116 Clade 7
Displayed as a position frequency matrix (PFM). Numbers in brackets [x] represent
strong PAM preferences, numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 28.10% | 11.55% | [100.00%] | 16.07% | /41.26%/ | 28.27% | 25.86% |
|  | A | 21.76% | 32.90% | 0.00% | [83.93%] | 29.91% | 23.75% | 24.55% |
|  | T | 12.65% | 37.58% | 0.00% | 0.00% | 27.98% | 29.78% | 28.58% |
|  | C | 37.49% | 17.98% | 0.00% | 0.00% | 0.85% | 18.21% | 21.01% |
| Consensus |  | N | N | G | A | D (G > W) | N | N |

TABLE 71

Protospacer adjacent motif (PAM) preferences for ID119 Clade 9
Displayed as a position frequency matrix (PFM). Numbers in brackets [x] represent
strong PAM preferences, numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 28.50% | [99.98%] | [99.96%] | 8.85% | 15.49% | 22.77% | 23.35% |
|  | A | 32.03% | 0.01% | 0.02% | 34.59% | 30.04% | 26.82% | 22.36% |
|  | T | 17.95% | 0.02% | 0.00% | /42.56%/ | 33.76% | 25.64% | 27.82% |
|  | C | 21.52% | 0.00% | 0.02% | 14.00% | 20.72% | 24.77% | 26.48% |
| Consensus |  | N | G | G | N(W > S) | N | N | N |

TABLE 72

Protospacer adjacent motif (PAM) preferences for ID120 Clade 9
Displayed as a position frequency matrix (PFM). Numbers in brackets [x] represent
strong PAM preferences, numbers in slashes /x/ represent weak PAM preferences.

|  |  | PAM Position | | | | | | |
|---|---|---|---|---|---|---|---|---|
|  |  | 1 | 2 | 3 | 4 | 5 | 6 | 7 |
| Nucleotide | G | 24.68% | [97.47%] | [100.00%] | 15.48% | [80.56%] | 34.49% | 27.40% |
|  | A | 20.40% | 1.49% | 0.00% | /46.59%/ | 2.72% | 19.17% | 33.53% |
|  | T | /40.19%/ | 0.40% | 0.00% | 36.15% | 16.69% | 36.64% | 29.09% |
|  | C | 14.72% | 0.65% | 0.00% | 1.79% | 0.03% | 9.70% | 9.98% |
| Consensus |  | N(T > V) | G | G | D(W > G) | G | N | N |

TABLE 73

Protospacer adjacent motif (PAM) preferences for ID121 Clade 9
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 21.64% | [99.88%] | [100.00%] | 18.79% | 8.85% | 18.07% | 23.75% |
| | A | 23.84% | 0.12% | 0.00% | /46.56%/ | 23.04% | 25.24% | 18.83% |
| | T | 29.96% | 0.00% | 0.00% | 30.30% | /50.13%/ | 30.47% | 30.07% |
| | C | 24.56% | 0.00% | 0.00% | 4.35% | 17.98% | 26.23% | 27.36% |
| Consensus | | N | G | G | D(A > T > G) | N(T > M > G) | N | N |

TABLE 74

Protospacer adjacent motif (PAM) preferences for ID122 Clade 9
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 24.43% | 19.65% | 0.02% | 1.20% | 5.14% | [98.14%] | 29.37% |
| | A | 20.98% | 28.14% | [99.98%] | [98.35%] | [94.63%] | 1.63% | 25.64% |
| | T | 35.18% | 31.89% | 0.00% | 0.00% | 0.00% | 0.23% | 24.28% |
| | C | 19.40% | 20.32% | 0.00% | 0.44% | 0.23% | 0.00% | 20.70% |
| Consensus | | N | N | A | A | A | G | N |

TABLE 75

Protospacer adjacent motif (PAM) preferences for ID123 Clade 9
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 39.61% | [99.95%] | [100.00%] | 17.78% | 6.15% | 16.45% | 24.04% |
| | A | 19.53% | 0.05% | 0.00% | /41.69%/ | 20.33% | 29.55% | 23.86% |
| | T | 23.46% | 0.00% | 0.00% | 36.41% | /56.54%/ | 26.96% | 28.20% |
| | C | 17.40% | 0.00% | 0.00% | 4.12% | 16.99% | 27.04% | 23.91% |
| Consensus | | N(G > H) | G | G | D | N(T > M > G) | N | N |

TABLE 76

Protospacer adjacent motif (PAM) preferences for ID124 Clade 7
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 16.86% | 16.49% | 20.40% | [88.50%] | 2.70% | /1.11%/ | 13.86% |
| | A | 32.84% | 30.59% | [78.18%] | 2.07% | [94.36%] | [95.77%] | [67.88%] |
| | T | 22.62% | 26.74% | 0.08% | 8.07% | 0.54% | 2.89% | 10.86% |
| | C | 27.68% | 26.18% | 1.34% | 1.36% | 2.40% | 0.23% | 7.40% |
| Consensus | | N | N | A | G | A | A | A |

TABLE 77

Protospacer adjacent motif (PAM) preferences for ID125 Clade 7
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 16.14% | 6.88% | 0.92% | 0.35% | 0.31% | 0.81% | 21.38% |
| | A | 23.49% | 21.94% | [98.19%] | [99.39%] | [99.27%] | [97.69%] | [64.31%] |
| | T | 32.76% | /43.27%/ | 0.17% | 0.09% | 0.09% | 0.89% | 9.87% |
| | C | 27.61% | 27.90% | 0.72% | 0.17% | 0.33% | 0.61% | 4.43% |
| Consensus | | N | N(T > M > G) | A | A | A | A | A |

TABLE 78

Protospacer adjacent motif (PAM) preferences for ID126 Clade 7
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 19.49% | 7.57% | [95.84%] | 2.21% | 27.10% | 8.72% | 10.45% |
| | A | 20.71% | 23.44% | 4.12% | 8.27% | /56.45%/ | [83.93%] | [68.27%] |
| | T | 16.90% | 25.97% | 0.00% | [57.84%] | 12.18% | 6.62% | 14.06% |
| | C | /42.90%/ | /43.02%/ | 0.04% | 31.68% | 4.27% | 0.73% | 7.22% |
| Consensus | | N(C > D) | N(C > W > G) | G | W(T > C) | D(A > G > T) | A | A |

TABLE 79

Protospacer adjacent motif (PAM) preferences for ID127 Clade 10
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 25.25% | 26.55% | 8.71% | 3.98% | 1.52% | 1.10% | 22.96% |
| | A | 12.91% | [69.11%] | [82.08%] | [95.92%] | [77.80%] | 0.09% | 27.92% |
| | T | 34.16% | 0.04% | 2.68% | 0.00% | 1.28% | [50.31%] | 24.96% |
| | C | 27.68% | 4.30% | 6.54% | 0.10% | 19.39% | [48.50%] | 24.16% |
| Consensus | | N | A | A | A | A | Y | N |

TABLE 80

Protospacer adjacent motif (PAM) preferences for ID131 Clade 9
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 32.38% | [45.99%] | [94.38%] | 10.89% | 11.50% | 22.57% | 17.71% |
| | A | 28.22% | [52.41%] | 4.24% | 33.95% | 26.70% | 26.58% | 27.18% |
| | T | 11.53% | 0.96% | 0.52% | 34.44% | /45.50%/ | 24.63% | 26.27% |
| | C | 27.87% | 0.64% | 0.86% | 20.73% | 16.30% | 26.22% | 28.85% |
| Consensus | | N | R | G | N | N | N | N |

TABLE 81

Protospacer adjacent motif (PAM) preferences for ID132 Clade 10
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 17.77% | 6.33% | 0.80% | [65.36%] | 5.70% | 11.21% | 14.11% |
| | A | 14.33% | [71.50%] | 6.90% | 26.81% | 33.68% | 4.99% | 37.97% |
| | T | 32.59% | 3.73% | [63.88%] | 0.00% | 34.29% | [68.57%] | 29.70% |
| | C | 35.31% | 18.44% | 28.42% | 7.83% | 26.34% | 15.22% | 18.21% |
| Consensus | | N | A | T | G | N (H > G) | T | N |

TABLE 82

Protospacer adjacent motif (PAM) preferences for ID136 Clade 9
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 17.84% | 25.26% | 38.64% | 3.86% | 0.06% | 0.44% | 15.50% |
| | A | 31.37% | 37.18% | 39.78% | [95.11%] | 0.49% | 0.16% | 12.36% |
| | T | 34.07% | 28.69% | 19.79% | 0.00% | [98.97%] | [98.40%] | [65.48%] |
| | C | 16.73% | 8.86% | 1.79% | 1.02% | 0.48% | 1.01% | 6.66% |
| Consensus | | N | N | D | A | T | T | T |

TABLE 83

Protospacer adjacent motif (PAM) preferences for ID138 Clade 10
Displayed as a position frequency matrix (PFM). Numbers in brackets [x] represent
strong PAM preferences, numbers in slashes /x/ represent weak PAM preferences.

| | | PAM Position | | | | | | |
|---|---|---|---|---|---|---|---|---|
| | | 1 | 2 | 3 | 4 | 5 | 6 | 7 |
| Nucleotide | G | 22.46% | 20.19% | 0.68% | 8.49% | [43.74%] | 0.00% | 9.78% |
| | A | 18.76% | [78.12%] | 10.48% | [91.44%] | [53.85%] | 18.32% | 19.57% |
| | T | 34.94% | 0.00% | [83.47%] | 0.00% | 1.09% | 11.13% | 30.01% |
| | C | 23.84% | 1.69% | 5.38% | 0.07% | 1.31% | [70.54%] | /40.64%/ |
| Consensus | | N | A | T | A | R | C | N(C > T > A > G) |

TABLE 84

Summary of cutting data for some of the Cas9 orthologs

| Cas9 Ortholog ID# | NT SEQID | PRT SEQ ID | blunt end cut | sticky end cut | in vitro | plant cell | HEK cell |
|---|---|---|---|---|---|---|---|
| 2 | 1 | 86 | X | | X | | |
| 3 | 2 | 87 | X | | X | | |
| 4 | 3 | 88 | X | | X | | |
| 5 | 4 | 89 | X | | X | | |
| 6 | 5 | 90 | X | | X | X | |
| 8 | 6 | 91 | X | | X | X | |
| 9 | 7 | 92 | X | | X | | |
| 12 | 8 | 93 | X | | X | | |
| 13 | 9 | 94 | X | | X | | |
| 16 | 10 | 95 | X | | X | | |
| 17 | 11 | 96 | X | | X | | X |
| 18 | 12 | 97 | X | | X | | |
| 19 | 13 | 98 | X | | X | | |
| 21 | 14 | 99 | | | | | |
| 27 | 15 | 100 | X | | X | | X |
| 28 | 16 | 101 | X | | X | | |
| 29 | 17 | 102 | X | | X | | |
| 30 | 18 | 103 | X | | X | | |
| 32 | 19 | 104 | X | | X | | |
| 33 | 20 | 105 | X | | X | X | X |
| 35 | 21 | 106 | X | | X | | |
| 41 | 22 | 107 | X | | X | | |
| 43 | 23 | 108 | | | | | |
| 44 | 24 | 109 | X | | X | | |
| 46 | 25 | 110 | | X | X | | X |
| 47 | 26 | 111 | X | | X | | |
| 48 | 27 | 112 | X | | X | X | X |
| 50 | 28 | 113 | | | X | X | |

TABLE 84-continued

Summary of cutting data for some of the Cas9 orthologs

| Cas9 Ortholog ID# | NT SEQID | PRT SEQ ID | blunt end cut | sticky end cut | in vitro | plant cell | HEK cell |
|---|---|---|---|---|---|---|---|
| 51 | 29 | 114 | X | | X | | |
| 52 | 30 | 115 | X | | X | | |
| 56 | 31 | 116 | X | | X | | X |
| 60 | 32 | 117 | X | | X | | |
| 61 | 33 | 118 | X | | X | X | |
| 63 | 34 | 119 | | X | X | X | |
| 64 | 35 | 120 | X | | X | X | X |
| 65 | 36 | 121 | X | | X | | |
| 66 | 37 | 122 | X | | X | | |
| 67 | 38 | 123 | X | | X | | |
| 68 | 39 | 124 | | X | X | X | |
| 70 | 40 | 125 | | X | X | X | |
| 71 | 41 | 126 | X | | X | | |
| 77 | 42 | 127 | X | | X | | |
| 78 | 43 | 128 | X | | X | | X |
| 79 | 44 | 129 | X | | X | | X |
| 80 | 45 | 130 | X | | X | X | |
| 81 | 46 | 131 | X | | X | | |
| 83 | 51 | 136 | X | | X | | |
| 84 | 52 | 137 | X | | X | | |
| 85 | 53 | 138 | X | | X | | |
| 87 | 47 | 132 | X | | X | | |
| 88 | 54 | 139 | X | | X | | |
| 91 | 55 | 140 | X | | X | | |
| 93 | 56 | 141 | X | | X | | |
| 94 | 48 | 133 | X | | X | | |
| 96 | 58 | 143 | X | | X | | |
| 97 | 49 | 134 | X | | X | | |
| 98 | 59 | 144 | X | | X | | |
| 101 | 60 | 145 | X | | X | | |
| 102 | 50 | 135 | | X | X | | |
| 103 | 61 | 146 | X | | X | | |
| 104 | 62 | 147 | X | | X | | |
| 105 | 63 | 148 | X | | X | | |
| 106 | 64 | 149 | X | | X | | |
| 107 | 65 | 150 | X | | X | | |
| 108 | 66 | 151 | | X | X | | |
| 109 | 67 | 152 | X | | X | | |
| 112 | 68 | 153 | X | | X | | |
| 116 | 69 | 154 | X | | X | | |
| 119 | 70 | 155 | | X | X | | |
| 120 | 71 | 156 | X | | X | | |
| 121 | 72 | 157 | X | | X | | |
| 122 | 73 | 158 | X | | X | | |
| 123 | 74 | 159 | X | | X | | |
| 124 | 75 | 160 | X | | X | | |
| 125 | 76 | 161 | X | | X | | |
| 126 | 77 | 162 | X | | X | | |
| 127 | 78 | 163 | X | | X | | |
| 131 | 79 | 164 | | X | X | | |
| 132 | 80 | 165 | X | | X | | |
| 136 | 81 | 166 | X | | X | | |
| 138 | 82 | 167 | X | | X | | |
| 139 | 57 | 142 | X | | X | | |

TABLE 85

Summary of eukaryotic cell data for some of the Cas9 orthologs % NHEJ mutant alleles for transient and stably transformed plants (averaged across one to three loci: MS26, MS45, and Lig), HEK293 cells transformed with DNA expression cassettes (averaged across two loci: WTAP and RunX1), and HEK293 cells transformed with RNP (ribonucleoprotein comprising Cas9 protein and sgRNA polyribonucleotide) for one locus (WTAP). *S. pyogenes* Cas9 was tested in parallel as a comparator.

| Cas9 Ortholog ID# | % NHEJ Mutant Alleles | | | |
|---|---|---|---|---|
| | *Zea mays* | | HEK293 | |
| | Transient | Stables | Expression Cassette | RNP |
| 3 | 0.00% | | 0.06% | 0.00% |
| 4 | 0.00% | | 0.00% | 0.00% |
| 5 | 0.00% | | 0.00% | 0.00% |
| 6 | 0.00% | | 0.29% | 3.02% |
| 8 | 0.00% | | 3.32% | 0.00% |
| 12 | 0.00% | | 0.00% | 0.00% |
| 13 | 0.00% | | 0.00% | 0.00% |
| 17 | 0.00% | | 1.52% | 0.00% |
| 18 | 0.00% | | 0.00% | 0.00% |
| 19 | 0.00% | | 0.07% | 0.00% |
| 27 | 0.00% | | 1.34% | 0.62% |
| 30 | 0.00% | | 0.00% | 0.00% |
| 33 | 1.20% | 43.75% | 5.32% | 28.40% |
| 35 | 0.00% | | 0.30% | 0.00% |
| 41 | 0.00% | | 0.00% | 0.00% |
| 46 | * | | 30.36% | 9.22% |
| 48 | 0.30% | | 4.05% | 0.00% |
| 50 | 0.22% | | 0.88% | 0.00% |
| 56 | 0.00% | | 17.13% | 0.00% |
| 61 | 0.18% | | 0.20% | 0.00% |
| 63 | 0.23% | | 0.00% | 0.00% |
| 64 | 0.43% | 50.39% | 4.00% | 6.45% |
| 67 | 0.00% | | 0.00% | 0.33% |
| 68 | 0.00% | | 2.67% | 0.85% |
| 70 | 0.24% | | 0.00% | 0.00% |
| 77 | 0.00% | | 0.26% | 0.00% |
| 78 | 0.00% | | 1.27% | 0.00% |
| 79 | 0.00% | | 3.34% | 0.92% |
| 80 | 0.07% | | 0.00% | 0.00% |
| 81 | 0.00% | | 0.00% | 0.00% |
| 87 | 0.00% | | 0.00% | 0.00% |
| 94 | 0.00% | | 0.00% | 0.00% |
| SpCas9 | 0.58% | 41.13% | 21.57% | 87.45% |

* indicates that heat shock is likely required for optimal activity in plants.

TABLE 86A

Cas9 Ortholog Amino Acid Position Scoring

| SpCas9 Position | A | R | N | D | C | Q | E | G | H | I | L | K | M | F | P | S | T | W | Y | V |
|---|---|---|---|---|---|---|---|---|---|---|---|---|---|---|---|---|---|---|---|---|
| 13 | 0.00 | 0.00 | 0.00 | 0.00 | 0.00 | 0.00 | 0.00 | -0.03 | 0.00 | 0.51 | -0.03 | 0.00 | 0.00 | 0.00 | 0.00 | -0.14 | -0.23 | 0.00 | 0.00 | -0.07 |
| 21 | 0.00 | 0.00 | -0.03 | 0.00 | 0.00 | 0.00 | 0.00 | 0.00 | 0.00 | 0.47 | 0.18 | 0.00 | 0.00 | 0.00 | 0.00 | -0.03 | -0.14 | 0.00 | -0.03 | -0.41 |
| 71 | 0.00 | -0.16 | -0.17 | 0.00 | 0.00 | -0.03 | 0.00 | 0.00 | -0.03 | 0.00 | 0.44 | 0.00 | 0.00 | 0.00 | 0.00 | 0.00 | 0.00 | 0.00 | 0.00 | -0.03 |
| 149 | 0.15 | 0.00 | 0.00 | 0.00 | 0.00 | 0.00 | -0.03 | 0.00 | -0.03 | -0.24 | 0.40 | 0.00 | 0.00 | -0.10 | 0.00 | 0.00 | 0.00 | 0.00 | 0.00 | -0.07 |
| 150 | -0.07 | 0.00 | 0.00 | -0.09 | 0.00 | 0.00 | -0.14 | 0.00 | -0.03 | 0.00 | 0.00 | 0.00 | -0.03 | 0.00 | 0.00 | 0.51 | -0.21 | 0.00 | 0.00 | -0.07 |
| 444 | -0.10 | 0.00 | 0.00 | 0.00 | 0.00 | 0.00 | 0.00 | 0.00 | 0.00 | -0.24 | 0.44 | -0.03 | -0.07 | 0.04 | 0.00 | 0.00 | 0.00 | 0.00 | 0.00 | 0.00 |
| 445 | -0.03 | -0.03 | 0.11 | -0.03 | 0.00 | 0.00 | 0.11 | 0.00 | 0.00 | -0.03 | 0.00 | 0.11 | 0.00 | -0.84 | 0.00 | 0.00 | 0.51 | 0.00 | -0.07 | 0.00 |
| 503 | 0.00 | 0.00 | 0.00 | -0.03 | 0.00 | -0.03 | -0.03 | 0.00 | 0.00 | -0.07 | -0.07 | 0.00 | -0.03 | -0.08 | 0.00 | -0.03 | 0.00 | 0.00 | 0.00 | 0.00 |
| 587 | 0.54 | 0.00 | 0.00 | -0.10 | 0.00 | 0.00 | 0.00 | 0.00 | 0.00 | 0.07 | -0.17 | 0.00 | 0.00 | 0.41 | 0.40 | -0.03 | 0.00 | 0.00 | -0.07 | -0.03 |
| 620 | -0.07 | -0.03 | -0.03 | 0.00 | 0.00 | -0.07 | 0.00 | -0.07 | -0.03 | -0.24 | 0.00 | 0.00 | 0.00 | 0.00 | 0.00 | -0.03 | 0.00 | 0.00 | 0.00 | 0.08 |
| 623 | 0.00 | 0.00 | 0.00 | -0.03 | 0.00 | 0.00 | 0.00 | 0.00 | -0.21 | -0.10 | 0.69 | 0.00 | -0.07 | 0.00 | 0.00 | -0.14 | 0.00 | 0.00 | 0.00 | 0.00 |
| 624 | 0.00 | -0.03 | 0.00 | 0.00 | 0.00 | 0.14 | 0.00 | 0.00 | 0.00 | -0.07 | -0.14 | -0.03 | 0.00 | 0.00 | 0.00 | -0.17 | 0.44 | 0.00 | 0.00 | -0.07 |
| 632 | 0.11 | 0.00 | 0.00 | 0.00 | 0.00 | 0.00 | 0.00 | 0.00 | 0.00 | 0.55 | -0.24 | -0.03 | 0.00 | -0.14 | 0.00 | 0.00 | -0.03 | 0.00 | -0.03 | -0.03 |
| 692 | 0.00 | -0.17 | -0.09 | -0.07 | 0.00 | 0.50 | 0.00 | -0.07 | -0.03 | 0.00 | -0.10 | -0.07 | 0.00 | 0.00 | 0.00 | 0.00 | 0.00 | 0.00 | -0.07 | 0.00 |
| 701 | -0.10 | 0.00 | 0.00 | -0.03 | 0.00 | 0.00 | 0.00 | 0.00 | 0.00 | 0.00 | 0.62 | 0.00 | -0.03 | -0.03 | 0.00 | -0.03 | 0.00 | 0.00 | -0.10 | 0.00 |
| 781 | 0.00 | -0.07 | 0.00 | -0.03 | 0.00 | -0.03 | 0.00 | -0.03 | 0.00 | 0.44 | -0.10 | -0.03 | 0.07 | 0.00 | 0.00 | 0.00 | 0.00 | -0.03 | 0.00 | -0.07 |
| 810 | -0.03 | -0.24 | -0.03 | -0.03 | 0.00 | 0.00 | 0.00 | 0.14 | 0.00 | 0.00 | 0.00 | 0.41 | -0.03 | 0.00 | 0.00 | -0.03 | 0.00 | 0.00 | 0.00 | 0.00 |
| 908 | 0.00 | 0.00 | 0.11 | 0.00 | 0.00 | -0.06 | -0.03 | 0.00 | 0.00 | -0.17 | 0.48 | 0.00 | -0.07 | -0.14 | 0.00 | 0.00 | -0.03 | 0.00 | 0.00 | 0.00 |
| 931 | -0.31 | 0.00 | 0.00 | 0.00 | 0.00 | 0.00 | 0.00 | 0.00 | -0.03 | 0.04 | -0.06 | 0.00 | 0.00 | 0.00 | 0.00 | 0.00 | -0.07 | 0.00 | 0.00 | 0.40 |
| 933 | -0.03 | -0.07 | 0.40 | -0.03 | 0.00 | 0.36 | -0.17 | -0.03 | -0.03 | -0.07 | -0.03 | -0.10 | 0.00 | 0.00 | 0.00 | -0.03 | -0.07 | 0.00 | 0.00 | -0.07 |
| 954 | -0.03 | -0.24 | -0.10 | -0.03 | 0.00 | -0.07 | -0.14 | 0.14 | -0.10 | -0.48 | 0.00 | 0.47 | -0.03 | 0.00 | 0.00 | -0.03 | 0.11 | 0.00 | 0.00 | 0.00 |
| 955 | 0.00 | 0.00 | 0.00 | 0.00 | 0.00 | 0.00 | 0.00 | 0.00 | 0.00 | -0.03 | 0.00 | 0.00 | 0.00 | -0.03 | 0.00 | -0.03 | 0.00 | 0.00 | 0.00 | 0.48 |
| 1000 | -0.03 | 0.04 | 0.00 | 0.00 | -0.03 | -0.03 | 0.07 | -0.03 | 0.00 | -0.03 | -0.07 | 0.44 | 0.00 | -0.03 | 0.00 | -0.03 | -0.10 | 0.00 | -0.10 | -0.14 |
| 1100 | -0.17 | 0.00 | 0.00 | 0.00 | 0.00 | -0.10 | -0.17 | 0.00 | 0.00 | 0.00 | -0.03 | -0.07 | 0.00 | 0.11 | -0.21 | -0.03 | 0.00 | 0.00 | 0.00 | 0.62 |
| 1232 | 0.00 | 0.00 | 0.11 | -0.03 | 0.00 | 0.00 | -0.08 | -0.03 | -0.14 | 0.00 | 0.00 | -0.06 | 0.00 | -0.10 | -0.03 | -0.07 | 0.00 | -0.03 | 0.44 | 0.00 |
| 1236 | -0.03 | 0.00 | -0.03 | 0.00 | -0.03 | 0.00 | 0.00 | 0.00 | 0.00 | 0.51 | 0.11 | 0.00 | 0.00 | -0.21 | 0.00 | 0.00 | 0.00 | 0.00 | 0.00 | -0.31 |

Scoring od specific amino acid positions of individual Cas9 orthologs (referenced versus the position in the SpyCas9 sequence SEQID NO: 1125).
The overall fraction of each amino acid at each position in the active and non-active datasets was defined by summing and dividing by the total number in each dataset, respectively.
Then, the non-active dataset was subtracted from the active with positive values indicating conserved amino acids in the active Cas9s that were under-represented in the non-active collection.
Final scores >= 0.25 are indicated with a • (circular) symbol, and were used to create "fingerprints" to identify active Cas9 orthologs.

TABLE 86B

Active Cas9 ortholog fingerprints
Signature amino acid residues for orthologs possessing a higher probability of activity in eukaryotic cells. Position numbers are with respect to the analagous amino acid position numbers of S. pyogenes Cas9 (SEQID NO: 1125). Orthologs with positive cutting activity in eukaryotic cells comprise one or more of these structural features.

| Relative Position | Amino Acid |
|---|---|
| 13 | I |
| 21 | I |
| 71 | L |
| 149 | L |
| 150 | S |
| 444 | L |
| 445 | T |
| 503 | P |
| 587 | F |
| 620 | A |
| 623 | L |
| 624 | T |
| 632 | I |
| 692 | Q |
| 702 | L |
| 781 | I |
| 810 | K |
| 908 | L |
| 931 | V |
| 933 | N or Q |
| 954 | K |
| 955 | V |
| 1000 | K |
| 1100 | V |
| 1232 | Y |
| 1236 | I |

TABLE 86C

Cas9 ortholog amino acid position total score (sums)

| PRT SEQID | Total Score | PRT SEQID | Total Score | PRT SEQID | Total Score | PRT SEQID | Total Score | PRT SEQID | Total Score | PRT SEQID | Total Score | PRT SEQID | Total Score | PRT SEQID | Total Score |
|---|---|---|---|---|---|---|---|---|---|---|---|---|---|---|---|
| 527 | 11.64 | 1005 | 8.46 | 1126 | 6.97 | 708 | 5.85 | 1078 | 5.05 | 998 | 4.17 | 772 | 3.72 | 714 | 3.29 |
| 116 | 11.43 | 885 | 8.39 | 841 | 6.90 | 855 | 5.84 | 564 | 5.02 | 152 | 4.16 | 892 | 3.71 | 859 | 3.29 |
| 860 | 11.19 | 110 | 8.37 | 546 | 6.89 | 138 | 5.74 | 1133 | 5.02 | 656 | 4.16 | 723 | 3.70 | 1081 | 3.29 |
| 868 | 11.09 | 125 | 8.36 | 1059 | 6.86 | 512 | 5.70 | 103 | 5.01 | 888 | 4.13 | 789 | 3.69 | 712 | 3.28 |
| 115 | 10.69 | 157 | 8.32 | 1028 | 6.83 | 932 | 5.67 | 1016 | 5.01 | 1036 | 4.13 | 515 | 3.69 | 736 | 3.28 |
| 160 | 10.66 | 691 | 8.32 | 981 | 6.80 | 143 | 5.66 | 1047 | 4.98 | 839 | 4.10 | 853 | 3.69 | 1009 | 3.28 |
| 162 | 10.65 | 697 | 8.32 | 1042 | 6.76 | 980 | 5.64 | 1114 | 4.96 | 1082 | 4.10 | 926 | 3.69 | 1097 | 3.27 |
| 666 | 10.25 | 801 | 8.32 | 939 | 6.76 | 648 | 5.64 | 970 | 4.89 | 543 | 4.09 | 1130 | 3.69 | 525 | 3.26 |
| 821 | 10.25 | 1121 | 8.32 | 678 | 6.75 | 856 | 5.62 | 684 | 4.87 | 513 | 4.08 | 551 | 3.68 | 717 | 3.25 |
| 633 | 10.21 | 1122 | 8.32 | 754 | 6.71 | 680 | 5.61 | 108 | 4.85 | 706 | 4.07 | 907 | 3.68 | 837 | 3.25 |
| 514 | 10.18 | 1123 | 8.28 | 913 | 6.68 | 661 | 5.56 | 1015 | 4.82 | 1041 | 4.07 | 530 | 3.66 | 730 | 3.25 |
| 105 | 10.15 | 953 | 8.25 | 999 | 6.67 | 664 | 5.53 | 102 | 4.79 | 1077 | 4.07 | 1010 | 3.66 | 803 | 3.25 |
| 922 | 10.07 | 793 | 8.11 | 751 | 6.59 | 735 | 5.51 | 1068 | 4.78 | 1106 | 4.07 | 852 | 3.64 | 899 | 3.24 |
| 169 | 9.85 | 877 | 7.97 | 159 | 6.53 | 727 | 5.48 | 123 | 4.71 | 1061 | 4.06 | 1131 | 3.64 | 607 | 3.23 |
| 526 | 9.85 | 1076 | 7.89 | 570 | 6.53 | 679 | 5.47 | 750 | 4.69 | 532 | 4.06 | 711 | 3.63 | 645 | 3.22 |
| 168 | 9.73 | 11 | 7.88 | 571 | 6.52 | 993 | 5.47 | 715 | 4.66 | 1014 | 4.02 | 845 | 3.62 | 631 | 3.21 |
| 660 | 9.70 | 911 | 7.87 | 531 | 6.51 | 802 | 5.45 | 518 | 4.62 | 990 | 4.01 | 641 | 3.59 | 719 | 3.21 |
| 1102 | 9.64 | 669 | 7.84 | 985 | 6.51 | 936 | 5.44 | 806 | 4.61 | 1128 | 4.01 | 997 | 3.58 | 840 | 3.21 |
| 756 | 9.59 | 630 | 7.84 | 948 | 6.50 | 826 | 5.42 | 1004 | 4.60 | 90 | 3.98 | 613 | 3.57 | 1002 | 3.21 |
| 978 | 9.43 | 799 | 7.84 | 949 | 6.50 | 126 | 5.40 | 659 | 4.59 | 1092 | 3.96 | 910 | 3.57 | 1105 | 3.21 |
| 589 | 9.30 | 1032 | 7.84 | 792 | 6.34 | 559 | 5.40 | 580 | 4.58 | 807 | 3.94 | 718 | 3.57 | 769 | 3.20 |
| 726 | 9.30 | 1039 | 7.84 | 849 | 6.34 | 590 | 5.40 | 884 | 4.57 | 119 | 3.94 | 923 | 3.56 | 1066 | 3.19 |
| 1038 | 9.30 | 1048 | 7.80 | 759 | 6.33 | 592 | 5.40 | 552 | 4.54 | 614 | 3.91 | 720 | 3.55 | 141 | 3.19 |
| 942 | 9.26 | 741 | 7.77 | 716 | 6.33 | 1117 | 5.40 | 987 | 4.53 | 572 | 3.88 | 873 | 3.55 | 707 | 3.18 |
| 113 | 9.26 | 121 | 7.75 | 941 | 6.32 | 539 | 5.39 | 947 | 4.50 | 815 | 3.87 | 134 | 3.54 | 878 | 3.18 |
| 161 | 9.26 | 624 | 7.71 | 848 | 6.32 | 729 | 5.38 | 603 | 4.50 | 850 | 3.87 | 902 | 3.53 | 127 | 3.17 |
| 681 | 9.26 | 112 | 7.58 | 117 | 6.31 | 797 | 5.37 | 693 | 4.42 | 602 | 3.85 | 1085 | 3.49 | 153 | 3.17 |
| 1049 | 9.16 | 101 | 7.50 | 553 | 6.29 | 780 | 5.37 | 765 | 4.42 | 745 | 3.85 | 876 | 3.48 | 600 | 3.17 |
| 938 | 9.09 | 114 | 7.50 | 835 | 6.28 | 654 | 5.34 | 668 | 4.41 | 757 | 3.85 | 810 | 3.47 | 644 | 3.17 |
| 898 | 8.98 | 966 | 7.48 | 1045 | 6.27 | 104 | 5.32 | 794 | 4.39 | 634 | 3.85 | 989 | 3.46 | 657 | 3.17 |
| 158 | 8.90 | 586 | 7.44 | 808 | 6.27 | 927 | 5.30 | 882 | 4.35 | 579 | 3.84 | 955 | 3.45 | 945 | 3.17 |
| 777 | 8.90 | 124 | 7.44 | 118 | 6.23 | 139 | 5.30 | 1099 | 4.33 | 804 | 3.84 | 961 | 3.45 | 874 | 3.15 |
| 891 | 8.86 | 155 | 7.44 | 598 | 6.17 | 918 | 5.30 | 820 | 4.32 | 895 | 3.84 | 107 | 3.44 | 569 | 3.15 |
| 120 | 8.83 | 690 | 7.44 | 604 | 6.17 | 1050 | 5.23 | 881 | 4.31 | 109 | 3.83 | 145 | 3.44 | 132 | 3.14 |
| 946 | 8.83 | 636 | 7.40 | 1134 | 6.10 | 619 | 5.20 | 653 | 4.30 | 695 | 3.83 | 976 | 3.44 | 606 | 3.14 |
| 937 | 8.79 | 623 | 7.36 | 790 | 6.09 | 1074 | 5.17 | 1056 | 4.28 | 1008 | 3.83 | 612 | 3.43 | 767 | 3.14 |
| 944 | 8.79 | 1072 | 7.31 | 519 | 6.08 | 812 | 5.16 | 924 | 4.27 | 696 | 3.81 | 701 | 3.39 | 784 | 3.14 |
| 1031 | 8.79 | 713 | 7.29 | 140 | 6.06 | 764 | 5.16 | 811 | 4.26 | 1001 | 3.81 | 167 | 3.37 | 148 | 3.13 |
| 865 | 8.79 | 722 | 7.22 | 774 | 6.06 | 1043 | 5.16 | 903 | 4.26 | 637 | 3.81 | 582 | 3.37 | 791 | 3.12 |
| 156 | 8.73 | 1064 | 7.18 | 795 | 6.02 | 164 | 5.15 | 788 | 4.24 | 1115 | 3.81 | 640 | 3.36 | 1024 | 3.12 |
| 762 | 8.73 | 916 | 7.18 | 972 | 5.95 | 883 | 5.15 | 901 | 4.24 | 890 | 3.80 | 781 | 3.36 | 705 | 3.12 |
| 833 | 8.71 | 688 | 7.16 | 106 | 5.93 | 1044 | 5.13 | 958 | 4.24 | 854 | 3.80 | 1080 | 3.34 | 996 | 3.11 |
| 747 | 8.71 | 725 | 7.14 | 587 | 5.92 | 904 | 5.13 | 1135 | 4.24 | 520 | 3.79 | 599 | 3.33 | 879 | 3.11 |
| 842 | 8.71 | 934 | 7.00 | 731 | 5.91 | 782 | 5.12 | 674 | 4.22 | 542 | 3.79 | 871 | 3.33 | 521 | 3.10 |
| 732 | 8.60 | 628 | 6.99 | 100 | 5.90 | 851 | 5.09 | 540 | 4.21 | 710 | 3.79 | 1058 | 3.33 | 758 | 3.10 |
| 935 | 8.57 | 1120 | 6.99 | 1023 | 5.90 | 683 | 5.09 | 1086 | 4.21 | 749 | 3.76 | 896 | 3.32 | 1019 | 3.10 |

TABLE 86C-continued

Cas9 ortholog amino acid position total score (sums)

| PRT SEQID | Total Score | PRT SEQID | Total Score | PRT SEQID | Total Score | PRT SEQID | Total Score | PRT SEQID | Total Score | PRT SEQID | Total Score | PRT SEQID | Total Score | PRT SEQID | Total Score |
|---|---|---|---|---|---|---|---|---|---|---|---|---|---|---|---|
| 967 | 8.54 | 861 | 6.97 | 592 | 5.90 | 1026 | 5.05 | 1025 | 4.19 | 1067 | 3.74 | 98 | 3.32 | 575 | 3.10 |
| 893 | 8.47 | 862 | 6.97 | 122 | 5.88 | 1037 | 5.05 | 658 | 4.17 | 737 | 3.72 | 151 | 3.30 | 813 | 3.10 |
| 574 | 3.09 | 671 | 2.76 | 738 | 2.58 | 763 | 2.23 | 973 | 1.86 | 798 | 1.64 | 585 | 0.99 | | |
| 694 | 3.09 | 771 | 2.75 | 549 | 2.51 | 894 | 2.23 | 149 | 1.85 | 140 | 1.57 | 597 | 0.99 | | |
| 662 | 3.07 | 889 | 2.74 | 921 | 2.48 | 1095 | 2.23 | 778 | 1.84 | 675 | 1.54 | 670 | 0.99 | | |
| 535 | 3.07 | 920 | 2.74 | 917 | 2.44 | 886 | 2.22 | 1109 | 1.84 | 739 | 1.53 | 700 | 0.99 | | |
| 561 | 3.07 | 1098 | 2.74 | 135 | 2.42 | 146 | 2.20 | 547 | 1.84 | 704 | 1.51 | 746 | 0.99 | | |
| 621 | 3.07 | 131 | 2.74 | 154 | 2.42 | 643 | 2.20 | 761 | 1.84 | 1104 | 1.49 | 783 | 0.99 | | |
| 629 | 3.06 | 1046 | 2.74 | 524 | 2.42 | 838 | 2.20 | 857 | 1.84 | 595 | 1.47 | 615 | 0.96 | | |
| 900 | 3.06 | 545 | 2.71 | 677 | 2.42 | 130 | 2.20 | 1110 | 1.84 | 92 | 1.46 | 642 | 0.96 | | |
| 1017 | 3.05 | 550 | 2.71 | 136 | 2.41 | 974 | 2.19 | 94 | 1.83 | 529 | 1.46 | 733 | 0.96 | | |
| 1073 | 3.05 | 805 | 2.71 | 914 | 2.41 | 992 | 2.19 | 584 | 1.83 | 959 | 1.46 | 956 | 0.96 | | |
| 994 | 3.03 | 984 | 2.71 | 968 | 2.41 | 1012 | 2.18 | 1052 | 1.83 | 768 | 1.45 | 652 | 0.96 | | |
| 563 | 3.03 | 166 | 2.71 | 988 | 2.41 | 1096 | 2.17 | 672 | 1.83 | 91 | 1.43 | 766 | 0.96 | | |
| 1003 | 3.02 | 915 | 2.70 | 743 | 2.37 | 573 | 2.16 | 523 | 1.82 | 1018 | 1.42 | 925 | 0.96 | | |
| 905 | 3.00 | 1040 | 2.70 | 825 | 2.37 | 625 | 2.16 | 682 | 1.82 | 86 | 1.40 | 1084 | 0.96 | | |
| 635 | 3.00 | 875 | 2.69 | 950 | 2.37 | 647 | 2.16 | 844 | 1.81 | 88 | 1.40 | 1111 | 0.96 | | |
| 1087 | 2.98 | 796 | 2.69 | 1030 | 2.37 | 709 | 2.16 | 740 | 1.80 | 516 | 1.40 | 836 | 0.94 | | |
| 544 | 2.95 | 665 | 2.68 | 129 | 2.36 | 866 | 2.16 | 823 | 1.80 | 609 | 1.40 | 1029 | 0.92 | | |
| 558 | 2.95 | 755 | 2.68 | 1034 | 2.36 | 897 | 2.16 | 610 | 1.80 | 689 | 1.40 | 1075 | 0.92 | | |
| 626 | 2.95 | 770 | 2.67 | 646 | 2.35 | 1007 | 2.16 | 620 | 1.80 | 1132 | 1.40 | 933 | 0.91 | | |
| 651 | 2.89 | 969 | 2.67 | 1093 | 2.35 | 93 | 2.14 | 1088 | 1.80 | 537 | 1.39 | 809 | 0.88 | | |
| 773 | 2.89 | 1089 | 2.67 | 1107 | 2.34 | 748 | 2.14 | 1101 | 1.80 | 560 | 1.39 | 919 | 0.88 | | |
| 685 | 2.88 | 1116 | 2.67 | 616 | 2.31 | 957 | 2.14 | 611 | 1.79 | 567 | 1.39 | 1054 | 0.88 | | |
| 1006 | 2.88 | 555 | 2.66 | 1053 | 2.31 | 827 | 2.13 | 847 | 1.79 | 818 | 1.39 | 1079 | 0.88 | | |
| 618 | 2.88 | 639 | 2.66 | 816 | 2.31 | 870 | 2.13 | 843 | 1.77 | 830 | 1.39 | 87 | 0.48 | | |
| 699 | 2.86 | 724 | 2.66 | 1070 | 2.31 | 686 | 2.09 | 676 | 1.76 | 1108 | 1.38 | 554 | 0.48 | | |
| 1112 | 2.86 | 931 | 2.66 | 557 | 2.30 | 702 | 2.09 | 1083 | 1.76 | 594 | 1.36 | 627 | 0.48 | | |
| 822 | 2.85 | 977 | 2.66 | 979 | 2.30 | 533 | 2.05 | 863 | 1.76 | 622 | 1.36 | 775 | 0.48 | | |
| 912 | 2.84 | 1033 | 2.66 | 601 | 2.27 | 99 | 2.01 | 142 | 1.75 | 753 | 1.36 | 817 | 0.48 | | |
| 144 | 2.83 | 785 | 2.66 | 632 | 2.27 | 565 | 1.98 | 906 | 1.75 | 1113 | 1.36 | 824 | 0.48 | | |
| 1055 | 2.83 | 872 | 2.66 | 846 | 2.27 | 828 | 1.98 | 1069 | 1.75 | 1129 | 1.36 | 1063 | 0.48 | | |
| 150 | 2.82 | 1090 | 2.66 | 538 | 2.27 | 1065 | 1.98 | 964 | 1.74 | 577 | 1.33 | 1100 | 0.48 | | |
| 528 | 2.82 | 869 | 2.65 | 596 | 2.27 | 534 | 1.97 | 760 | 1.73 | 1119 | 1.33 | 1103 | 0.48 | | |
| 591 | 2.82 | 963 | 2.65 | 578 | 2.26 | 1020 | 1.96 | 940 | 1.73 | 95 | 1.32 | 928 | 0.40 | | |
| 703 | 2.82 | 1091 | 2.65 | 951 | 2.26 | 971 | 1.94 | 975 | 1.73 | 97 | 1.32 | 960 | 0.40 | | |
| 779 | 2.82 | 929 | 2.64 | 986 | 2.26 | 133 | 1.91 | 1000 | 1.73 | 752 | 1.32 | | | | |
| 1051 | 2.82 | 541 | 2.64 | 96 | 2.25 | 568 | 1.91 | 1057 | 1.73 | 786 | 1.32 | | | | |
| 649 | 2.81 | 617 | 2.64 | 522 | 2.25 | 834 | 1.91 | 583 | 1.72 | 1071 | 1.32 | | | | |
| 880 | 2.81 | 787 | 2.64 | 965 | 2.25 | 588 | 1.90 | 721 | 1.72 | 650 | 1.31 | | | | |
| 954 | 2.81 | 1118 | 2.64 | 995 | 2.25 | 991 | 1.90 | 673 | 1.69 | 734 | 1.31 | | | | |
| 165 | 2.81 | 687 | 2.63 | 137 | 2.24 | 1022 | 1.90 | 1094 | 1.68 | 983 | 1.31 | | | | |
| 1011 | 2.81 | 908 | 2.63 | 831 | 2.24 | 887 | 1.89 | 698 | 1.66 | 147 | 1.29 | | | | |
| 909 | 2.80 | 930 | 2.63 | 605 | 2.24 | 562 | 1.87 | 536 | 1.66 | 517 | 1.29 | | | | |
| 829 | 2.79 | 1027 | 2.63 | 608 | 2.24 | 576 | 1.87 | 943 | 1.66 | 814 | 1.29 | | | | |
| 692 | 2.78 | 744 | 2.61 | 728 | 2.24 | 581 | 1.87 | 961 | 1.66 | 867 | 1.28 | | | | |
| 1060 | 2.78 | 128 | 2.60 | 1021 | 2.24 | 654 | 1.87 | 1062 | 1.66 | 864 | 1.10 | | | | |
| 858 | 2.78 | 800 | 2.60 | 566 | 2.23 | 1013 | 1.87 | 819 | 1.65 | 982 | 1.06 | | | | |
| 163 | 2.77 | 832 | 2.60 | 638 | 2.23 | 1124 | 1.87 | 556 | 1.64 | 89 | 0.99 | | | | |
| 663 | 2.77 | 952 | 2.58 | 667 | 2.23 | 776 | 1.86 | 742 | 1.64 | 548 | 0.99 | | | | |

SEQUENCE LISTING (1829 sequences)

SEQ ID NO: 1 - DNA, 4143 bp, Prevotella histicola
atgaagaagattctgggattagacttagggactacaagcattggttgggccttagtatatgagagtgagaatgcagatgaaaaatcatctatagttagacttggtgtgagggttaatcctttaagtgtagatgaaaaaggcaactttgaaaaaggcaaatctattacaactaatgctgataggcagcaaacccatggtgcaaggataaacctccagcgctataaattacgtagagagaatcttaaagattgtctgcagaaacaaggttggattggaacagaggcattgtatgaagaggggaaaacttctacttttgaaacctatatgttacgtgcaaaagctgcagaagaagagatatcattacatgaactctgtcgagttctgtttatgctgaataagaaacgtggctataagagtaatcgaaaggcaaataataaagaagatggaaagctttttgatggaatgactgttgccaaaaaactctatgaagagcacttaactcctgcagaatattcactcaaattacttagtagtgggaagaagtttaagcaagagtactatcgttccgatctaaaagaagagttcgatagaatatggaatgagcagcagaagtactatcctgagatacttacggatgattttaaacagcagttgcaaggaaaatcaaagggaaatacaagtaagattttccttggtaaatatggtatttactctgcagatttaaaaggtctggataggaagttacaacctttgaaatggagggttgaagcgttgaaacagaaggtcgataaggaggtcttagcctttgttattagtgatttgaatgggcaaatagccagtacaagtggactgcttggtgctattagtgacagaagtaaagagctctactttaataaacagacagttggtcaatacctatggacttctttaaaagaaagtccacatgtaagtattaagaataaacctttctatcgtcaagactatttagatgaatttgaaaagatctgggagacgcaagcaacctatcataaggaactaactcctgaattgaagcaagaaatcagagatataattatcttttatcagcgaccattgaagagtaagaaggggctgatttcagtgtgtgagcttgaacaacgtaaggtaaaagtaactattgatgggaaagaaaaagaaatatctatcggtccgaaggttgcccctaagtcttctccaatgtttcaagagtttagaatttggcagaacctaaataatatactacttatagacaaaggaaataatagtaatcgtcctctgtacgaggaagagagaaatttattatatgaggaactaagtgttaaggagaaacttagtaaagctgaggctctaaaagtattgaacaagaatggtaaacaatgggatctgaattataaagaaatagaaggcaatcgtactcaggctgtcctctatgactgttataatcgaattatagggatgacgggacatgaagaatgtaatttcaaaaaactaaaagcctctgatattcgctataatgttaagacgatattcaagaatttaggtttcagtacagatatactagactttgactcatcactacaaggccatgagttggaaagacaaccttcgtatcagctttggcatctgttgtattcttatgaaagtgataactctcgaacaggtaatgatgctttattaaggaagttggagacagcatttagcattcctaaagaatatgcagcagtactttctgatgtggtctttgaggacagttatgggaatcttagtgtgaaggcaatgcgtaatatcttaccacatttgcaagcaggattagattatagtcaagcatgtgaaaaggcaggatataaacattcacgtcgctcacttacgaagaatgaactggataaaaaagaatataaggagaagttagaattattacccaagagtagtttacataatcctgttgttgagaagatactcaatcaaatgattaatgtgatcaatgcagttattgatgaatatggaaagcctgatgagataagaatagaattagctcgtgaactgaagattggagctgcagagcgagagaatatgacacgaagtattaatcaaggtaatgcagagaataaacgtattcgtgaaatactcgagaaggaatttgcactttcatatatcagtaggaatgacatcataaaatataagttatatgaagaacttaaatcgaatggctttaagactttatactctgacacgtatatatcaaaagataaactcttctcaaaagattttgatattgagcatattattccgaaagctcgtttgtttgatgattcactttcaaataagacaatcgaagcacgtgatgtaaatattgcaaagagtaataagactgcttttgattttatttctgaaaagtatgaccagcaagggattgaggcttataagaagaaactcgatattcttttgcaggatggttccattagtaaggctaagtacaatagattattaatgaaggaagcagatattccatcagggttcattgatcgtgaccttcgagatactcagtatatagcgaagaaagcgtatgaaatattaagtgacttagttaggaatgttacaccaacaacaggcgctgtgactagtcgtttgcgtgaagactggcagttagttgatgttatgaaagagcttaattttgagaagtatcaaaagttaggtttagtagaagtgatagaagatagggatggtaggaagataaagcgtataaaggattggaccaagcgtaatgaccatcgtcatcatgcgatggatgcattaacaattgcttttacgaaaccaagttatattcaatatctgaacaaccttaatgcacgaagtgataagaatagtagtatttatggcatagaaaataaagagctacatcgtgaagataacaagcttcgctttaatgctcctttgcctattaatgaatttagggcagaagctagaagacaccttaaatctatcttagtctctgttaaggcaaagaataaagtgatgacacagaatgtaaacgtgataaagacaaaacatggagtaattaaaaaggtgcaacttacgccacgtggagaattgcataatgctacattttatggaacaaagaaacgtccaataataaagatggtcaaagttggggctgcattagatgaagtaacaattaagaaagtaagtagttcctttattcgtgaggcgttgctggatagactccatgagtataatggtgatgctaagaaggcttttacaggaagaaattcaatagataagaaccctatttatatagatgaagagcacaaaaagactgttccagcattggttaaaacgatagagtgggagatgtatcaccctactcgaaagatgatatcaccagatcttaaaattgacaaagttatagataaaggtatacgagaaatcttaagaactcggttagcaaaatttaatggtgatgcccagaaggcctttagtaatttagatgaaaatcctatttataaggatgaagcaaagaagataaccttgaagcgagtcagccttgaaggagtttcaagtgtaattccgctacacaaacttaaggatatgggaggaaagccagttgttggaaaggatgggaagccggtatggggtgattatgttcaaacaagtaacaatcatcatattgctttttacatggatgagaatggtaacctgcaagatgatgtagtaaccttctttaaagctgcgaggcgtaaatcacaaggagtacccgttattgataagaactataatcacgataaaggttggcatttcctatttacaatgaagcaaaacgaatattttgtgttccctaatgaagcgacagggtttattcctaccgaagtggatttaatggacgaagccaattatgacatgataagtccaaatctatacagagttcaaaagatgtcaaaaacaaaacaaggcataaccgacaagagggattattggtttagacatcatttagagacagtacttaataacgatttaaaagttaggaactctatatttaaacaaataaattcattaaagcctttagaaggtattgtaaaggtgcgcatcaatgctattggcaaaatagtggcaataggagaatacgattaa

SEQ ID NO: 2 - DNA, 4212 bp, Chryseobacterium gallinarum
atggtggaaagaattttaggactcgacttaggagtttcttctataggctgggctcttgtagaggaagatgtgaaaaatccggaaaataacaagattataaaattaggagtaagagttaatcctttaacaatagatgagaaaaccaattttgaaaaaggtaaatctattacaactaatgccggacgtacttcagcgagaagcgcccgtaggaaccttcagcgttttaaactgagaagaaaaaaattattagagattttaattcattataaaatcataaaaaacgatgctgttctggctgaaacaggtaaaaacactactttccagacgcaatatctaagagcaaaagcggccagagaaaaaatagaactggatgaactggcaagggttcttcttctgatcaataaaaaaagaggatacaaaagcagcagaaaagtccaaaatgatgatgatggaaaagctattgacggattatcagtagcgaaggagttatatgagaaaaattataccccgggtcaatatgcctatgatcttttaaaaagagggaaaaaacagattccggatttttacagatcagatcttcaaaatgaattggatcgtatttgggaatttcaaaaacaatatcatcctgatattttaaccgatgaatttaaaaaagaacttgaaggaaagggacagagagcaactgccgctatttttctgaatcgttataaaatttacactgccgataataaaggaacacgggaagagaaaaagattcaggcttatcagtggcgagtagaggctctttctcagccattggatgttaaagaagtggcatatgtaattgcggaaattaataataatcttaataattccagtggatatcttggtgcgatcagtgatagaagtaaaaaactatattttaacggacaaacaataggagaatatctttttgaagagctttcagcgaatcctcatacccgtttgaaaaatcaggtgttttaccggcaagactatcaggatgagtttgaaaagatctggaaaatacagacaaaattccatcctgaattgactaaggaattgaaagaacaagttcgtgatattgttattttctaccaaagaaagctaaagtcacagaaagggctgataagtttttgtgaatttgaaagtagagaaattgaaattgaagaaaatggcaaaagaaaaaggaagaaggtcggattgaaagtagctcctaaatcttcacctttatttcaggaatttaaaatctggcaggttctcaataatatagaaataaagaatgaagatgaacgaaggtatttggagccggaagaaaaagaactgcttttcaatgagctgaattgtaaaggaaatcttacttcacaaaaatgcctggaacttttgggttttaaatcgaaagatgcaaaacttaattttaaagttgtggaaggaaacagaaccaatgaaaagttatatgatgcttttctgaaaattctggaactgcaaggctataatgtttttgagcttttaaaaataaaagaggataaggatgaggctaaattatctgaactgaaagcttctgctgacgagattaaagggatgataaaagagatttttaatgcaaatcttattaatacatccattcttgattttaatgcagaattggagggaaaggattttgaaaatcaggcttcttatcagttttggcatttgatgtattcttacgaaggggataattcgccatcagggaatgaaaaattatatgaattgctggagaagaaatttggctttaaaaaagaacactccaagattttatcaacgattgttttttcacaggagtatgggagcctgagtacaaaggctatgagaagaatttacccttatattaaagataataagtatagtgaagcatgtcttcttgctgggtataatcattctaagcactctttgactaaagaagaattggaaaacaggaaattaaaagagcaattggaggttttacctaaaaattctttacgaaatcctgttgttgaaaagattttaaatcagatgattaatcttgtgaatgctacaatttctgaatatggaaagttggatggagttagaatagagctagccagggagctgaagaaaagtgcacaggagcgtgaagatatggcgaagagtattaatgaagccacactccttcatcaaaaatatgcaactattttaaagcaagaatttggtgttgttaatccatccagaaatgatattatccgatacaaactatatatggaacttaccgttaacgggtataaagatctgtatactaatactaaaatagaaaaagaaaatctttttacagataagtatgatatagaccatattattccacagtcaaggttttttgatgatagtttttctaacaaggttttagttccacgacagtcaaacttagataaaggaaatctgactgcgtatgattttatgtctaataaagggagtgaaagagaagaacatttcctgaatgtaattaaagaattattggataaaggcagtatttcaaaagcaaaatatgaaaagctaaagaaaaaaggattagaaataggagatggatttatagaaagagatttgagagatactcaatatattgcaaaaaaagcaaaagaaattctttttgagattactaattctgtggtaaccacttcaggaagaatcacagacaaattaagaaaagattgggatcttgtcaatatcatgaaagaacttaatcttgataactacagaaggttaggtttaacagaaattgtcagaaattcaaaaggagaagagaaagaactcattccggattggacaaaacgtaatgatcaccgtcatcatgcaatggatgctcttaccgttgcattcactaccagaaatcatattcagtatctgaattatcttaatgcaagaaaagatgaaaagcataaagaacaccagaatatttatgctattgaaaatattattacagaagtcattgagaaaaaaaatggttcaaagaccaggagatttaaggctccaatgaatagtttcagacatgaagctaagcagcatctgaaggaaatattggtttcacataaaactaaaaataaagtagtaacctcaaatatcaataagactaagaaaaaaggagggattcataaaaaaacagaacttaccccacgaggacagcttcataaagaaacggtgtatggcagcaagaaatttctacaatcgagagaagaaaaagtatctgcaaagtttgactatgaaactatattaatggttgttaatccaatacatagaaatgcattactgaatagattgaaggaatatggaaacgatcctaaaaaggcattctcaggtaaaaatgcaataaataaaaaccctgtttacttggatgattctaagactgatattctttccgaaaaagttactctttcctggtacgagaccgggtatactattaggaaatctgttacgcctgataattttaaagactataagaatctggaaaaaataacagatcttggtataaagaaaattttaaaggaacgtcttgatcaatttaaaggaaatgcaaaagaagcattttctaatctggataaagatcctatctggctgaatgaagaaaaaggaattgcaataaaaaccgtaacgattactggtgtgagtaatgctgaatccttacactttaaaaaagatcatttgggtaaagaaattctggatgaaaatggaaataagatccccggagattttgtaagtactgggaataatcatcatttagctatttacttagatgaagaggaaaaacttgatgataaaatggttacattttatgaggcagttttaagagtaaatcaaggtttgcctgtaattgataaagactataataaggagaaagggtataagtttttaatgactttgaaacagaatgaaatgtttgtatttcctaatgaagattttgatcccaacgaaattgatctacttgatgagaggaacttagagcggatatccaagcatttatttagagttcagaaaatttcaaaggttgggtatggaaattcttttgtcagagattttgtattcaggcatcacttagaaacaaccgttgaagagagaaaagaactgcggaatataacctatatacagcttaaaagccttgaaggactaagaaatattataaaagtaagattgaatcacttgggaaaaatagtacaaataggtgaatattaa

SEQ ID NO: 3 - DNA, 4275 bp, Parabacteroides sp.
atgaaaaggattttaggcttggatttagggacaaatagtatagggtgggcgttggtgaacgaagctgaaacagatgaggaagtctcgtcaatcatccgattaggtgtgagagtaaatcctttgacagtagatgaaacgcagaactttgaaaaagggaaaagtatcactacaaatgcggaaagaactcttaaaagaagtatgcgccgtaatttgcagcgatataaattacgtcgtgatgcgttggttgaatttttgaaagagctgggttttattaccgacgaaactatcctttcggaacaaggaaacagaactacgtttgaaacctgtcgtttacgggctaaagctgctgaagaagagatttctttagaggaactatcccgtgtcttattgatgattaataaaaaacgtggatataaaagtagtcgaaaggtaaaaaaggaagaagatggagttttgattgatggaatggagattgctaaaaagctgtatgaggaggatttgactccggggcaactttgttcgcagttacttgaatcgggcaagaaagttttgccagacttttaccgttctgatttgcaagaagagttggatagaatatggagtgttcaaaagcaatttcatcctgatgttttctgtgatgccgccaaagaagaaatcaaaggaaaaaacagaagccagacatgggctatcttggctaactattttgtttggaaagaagaagtggttggctggaatgacagagaagcaaagaatgaaacgatagaaaaagaatgtaaacttgtcggtcttaaacggacgactaaggggtatgaactgaaaaaggaaaattatcgttggcgtgcgcaagctcttactgaacaattaggtttggaagagatagccgtagtcttgcaagagatcaatggtcagataaatgcgtctagtggttatttgggagccattagtgataggagcaaagtgttatactttaatcatcaaacggtcggacagtatcagatggctgagttagacaagaatccccatgcaagtttgcgcaatatggtattctatcggcaggattatttggatgaatttgatagaatttgggaaaagcaggcagaatttcataaggaattgacagctgaattgaaaaaagagattcgcgatatgatcatcttttaccaacgacgtctgaaaagtcagaaaggcttgattagtttctgtgagtttgaaaggttggagattgtagtagaaaaggatggaaagaaacagaccaaagtcataggatgcaaggtgatacctcgttcgcatccattgtttcaggaatttaaggtatggcagacattgaatgacataaaggtattgggaagagagaagaaaagaaatgctttgtcggcaagcgaaagtagggctttgtatccagaagaaaaagaaatactggcaagagaacttgcgataaaagaaaacatgaagaaagcagatgtgttgaagctcttatttgaaaatccacaggaattggatttgaacttcaaacaaatagatggaaatcgtactgggttttctctcttttctgcctatagcaaaatgatagaaaagtatggctacgaaccgttggattttaagaaaccagcagatgagataatcggacagctaagaactatctttaccgatttaggttggaatacgaatctgtttaccattgacttaaccaaagaggggaaagagctcgagatgcaaccttatttcagactttggcatctgttgtattcttttgaaggagataatacgtcgaccggtaacggcaaactgattgaaaagatcatgcaactttgcggagttgagaaagaatatgctgtagagctagccagtctttcgtttcaagatgattacggaagtttgagcgcgaaagccatcaaaaggattttaccctatttgaaagagggtaatctgtatgatgtggcttgtgaatatgccggttatcgtcattccaaatcttcactgactaaggaggagatagaaaataaggttttaaagggcaagctggaggttcttcctaaaaacagtctccgaaatccggtggttgaaaagattttgagtcagatggtgaatgtaatcaatacaatcattgatacgtatggaaaacctgatgaaatccgagtggaattggctcgtgaattaaagaagagtgccaaagaacgtgaggaactgacgaaagctatcgcaaagagtacccgtgagcatgaggagatccgtaaattgttgcaagatgaatttggtatgatgaacgtgagccgcaatgatattatccgttacaaactttatgaagagttgaaagataatggatataaaacattgtattccaatcaatatatacctaaagaaaagattttcagtaaggagatagatatagaacatattattccacaatcccgtctttttgatgattctttatctaacaagacattggagtataaggctattaatatagaaaagggaaataagaccgcttatgattttgtaaaagaaaaatatggagaagaaggcttgcaacaatatataaatcgttgcgaaagcttgttcaatgacaaaaaggcgaaacttcggaaattgaaaatggaacagaaggatataccggatggtttcattgatagggatttgagaaatacacaatatatagcgaaaaaagcactcgctatgttgaacgaaatctgccgtagagtagtggcaactaccggttccattacagatcaattgcgtgaagactggcaattggtggatgtaatgaaagaactgaacctgcctaaatatgaagccttgggttttgtggaaacatacgaagataaggacggaagaaaaatcaaaagaataaaggattggacaaaaaggaatgaccatcggcatcatgcgatggatgcgctgacggtagcttttacaaaggatgcgtttattcagtatttcaataataaaaatgcggcacaagattcaggcaatagaaaccatacgaatataataggtatcaagacccgttattttgacaaaggaagagctttgcctcctattccattggagcaattccggatagaagccaaacagcatttggaaaaactgctggtatctattaaagctaagaacaaggtggtgactgtcaatgttaatcgaacaaaaaagagaaagggtgaaaatacgaagatacagcaaactccgcgaggtcagttgcatttggaaacggtttatggtagtcacaaacaatatgtgacaaaaatagaaaaggtgaatgcttcttttgatgcggctaaaatagcgactgtgagtaaacgggcttatcgaaatgccttacttaaacggttggaaacattcggtaatgatccaaagaaagcatttacaggaaaaaatgcattggaaaagaatccgctttatgctgataagtatcagaccatacgagttccggagaaggtacaaacagttgaatttgaaactatttatactatccgaaaaccggtcgatcctgctttgaatgtggataaagtagttgatgtaaaggtacgtgctattttagaacggcgtttgaaagaatacggtggagatcccaaaaaggcatttgttaatttttgggaaaatccgatatggctgaataaggaaaaggggataagtatcaagcgggttagcatccgaggaatcaataatgcccaatcgatacacgtgaagaaagataagaatgggaatccgatatgggatgaaaatggaaaacaaatccctgtggattttgtaaataccggaaacaaccatcatgtggctatttatcgtaaacctgttttagacaagaaaggacaggtgacgtttgatgaggatggtaatctgatgtatgaactggacgaggtggttgtccccttctttgaggctgtaacacgggctaatttaggacttcctattattgataaggattacagaaaaagtgaaggttggcaatttttgtttagcatgaagcagaatgaatatttcgtgttcccgaatgaaaagacaggcttcaatccgaaggaggtggatttgttgaatccggataattatgcaatgattagtccgaatttatttagggtgcagactatgtcaaaagttatgtatggaaataatgttgttcgagattataaatttagacatcatttggaaacaacagtgaaagatatgaaagagttgaaagatattgcttataaacaatataaaacactttcttttggtaatagtgttgtcaagatccgaattaaccacattggacaaatagtatcagtgggagaatattaa

SEQ ID NO: 4 - DNA, 4293 bp, Capnocytophaga canis
atgaaacatatactcggtcttgatttagggacaaattcaattggttgggcttatgtaaaagaagccgaaaacgatactgaaacttcggagattgttgatttgggagtgagagtaaatccgctaacaaccgatgaaaaaacaaatttcgagaaagggaagcccatttctaccaatgccgatagaaccctgaaacgaagtgctagacgcaacctgcaacgctataagctccgtagaaaagaactcatcgaacttttgaaagaacatcaactcatttctgaaaatacaattttaacagaaaacggtaaaggaaccaccttccaaacattagaattacgagcaaaatcggctaaagaaaaaatatctttgggggaattggctcgtgtttttttaacgattaataaaaaaagaggttataaaagcagtcgaaaggctaaaaatgaagacgaagggcaactgatagacggaatggaaattgccaaaagactttatgaagaaaaccttactacaggacaattatctctacaacttttaaaagaaggtaaaaaatcattgcctgactattatcgttctgatttacagtttgaattggataaagtttggaactttcaaaagcagtttcattcggatattttgaccgatgaattttacgctcaacttaaaggtaaaggacaaagggcaaccagtgctttgtttttggcaaaataccaaatctataccgctgaaaataaaggaagtagagaagataaaaaattacaagcctatcaatggcgagtagatgctctctcaaaggaattgacaagggaagaattggcttttgtcattaccgaaatcaataataatttaaataattccagtggttatttgggggcaatttcagaccgaagcaaggaactttacttcaataatgaaaccgtaggcgagtatctttggaaacaaattgcagcaaatccgcatacttcgttgaaaaatcaggtgttttatcgccaagattatttagatgaatttgaacgaatttggaatacccaagctcaattttatccacaaattttgaccgagtccttaaaaaaagaacttcgagatgtggtgattttctaccaaagaaaactgaaatcgcaaaaatcattggtgagtttctgtgaatttgaaaataaggaaatagagattaaaaaagaagatggtacgagtaccaaaaaagtaatcggtcttaaagtagctccaaaatcatcgcctctgtttcaagagtttaaaatttggcagaatttaaacaatgtcttgattcgtaaaaaaggaagtaaaacgaaaaaagtagctaaaactcaacaagcagttctttttgaagaagagaaaacaatttccgaattggatttggaggcaaaacaagcattatttaatgagttaaatctcaaaggaaatctcaaagcggattattgtttggaaattttagggtattctcccaaagaatgggagatgaattatcctgaattagagggtagtagaacaaataaagcattatacgaagcatatttgaaaattactgatttagagggatatgatgctaaaaattacctcaaagtaaaattgaataaagatgaggtggagcttgatgatttgaaagttcctgcatcggaaatcaaggatatggttcaagcgatttttaaagaggcaggtatcaacacggatattctgcatttcaatgctgaattagacggtaaagattttgaaaatcaagcaagttatcagctttggcatttgctgtattcttatgaaggcgatgattctaaaagtggtaacgaattgctttataaattgttagaaacaaaattcggttttaaaaaagagtatgctcaaattttagcgaatgtttcgttatcagatgattatggtagtctatcgaccaaagcgatgcggaaaattcatccatatattaaggaaaataaattcagtaccgcctgtgaattagcaggttaccgccattctaaacattcattgaccaaagaagaaaacgataatcgtgtactgagggatagtttggaagtcttgaaaaagaatagtttgcgtcaaccggtagtagaaaaaattttaaatcagatgattaacttggtcaatgcgcttttaaagaaataccgaaccgaaacccctaactttaaattcgatgaaattcgtatagaattggctcgtgaactgaaaaaaaatgcggaagaaagagccaatatgacggcaaacatcaataaagcaaaaaccgaacacgaaaaaatcattaaaattttgaagaatgagtttggtttaccaaatccaacaagaaatgatattatccgttatcgtttgtacgaggaattaaaagcgaacggatataaggatttatatactaatataaaaattccacaagaaaaattatttactaaagaaatagatattgagcatattataccaaaatcaagaatatttgatgatagtttttcaaacaaaacgctttctttcagaaaaaccaatttagataaaggagaacggacggcatttgattatatggaaagtaaatttggagcggataaattggaagaatatgtggctcgtgtggaagatttgtatcgaaataatattatctccaaagcgaagtaccaaaaattattgaaaaaagaaagtgaaatcggagatggttttgtggaaagagatttgcgtgaaacacaatacattgctaaaaaagccaaagaaatacttttgcaaattactcgaaatgtgctttctacatcgggaggtattacggatagattgagggaagattgggatttggtcaatgtaatgaaagaactcaacttgccgaaatacagagccttggggcttaccgaaatggaagatcgtaagtatggtcagcaagtggaagttatcattgattggacaaaacgaaatgaccatcgccatcacgcaatggatgctcttacggtggcttttaccaaacacaatcatattcaatatcttaattatctgaatgctcgtaaaaatgaaaaacataaggagcatagcaatattatgggtattcagcaattggaaaccataaaagtaaccgataaaaatggtaatgaaaaaagagtttttaaagcaccaatgcccaatttccgtcaggtagccaaagcctttttggaaaatgttttaatttctcataaggctaaaaataaggtagttaccaaaaacaagaataaagttgcgggaagtaacaaagttcaggaagttttaactcctcgtggacaattgcataaagaaacagtttatgggaaataccagtattatgtacaaaaagaggaaaaaattggagggaaatttgatttggaaaccatcaaaaaagtagccaatccactgtatcaatccttgttgaaaaaaagattagaagaaaatggcggcgatccgaaaaaggcttttacaggtaaaaattcattggccaaaaatcctatttatttagatgatgcccaaacagaacaactgcctgaaaaagtgaaattggtatggctagaaaatagtttttccatccgaaaagacattactcctgaaaactttaaagatgaaaagctaatcgacaaaatattagacgaaggggtaaagagaattttgaaagaacgactacaatcttttggaaacgatgctaaaaaagccttttcagatttagacaaaaatccgatatggctcaataaagagaaaggaattgcgataaagcgtgtaaccataagcggtgtagcaaatgccgagcctttgcataccaaaaaagaccatttaggcaaagaaattttggataaagaaggtaagcctattcctgtggattttatcagtacgggcagcaatcatcatgtagcggtttaccgtgatgagaagggaaatttacaagaaaaagtagtatcggtttttgaagctgtggtaagagccaatcaaggtttgccaataatagacaaaacatacaatcagcatttgggttgggaatttttgttcacaatgaaacagaatgaaatgtttgtcttcccgaatgaatcaacaggatttaatcctaacgatattgatttattagaccctaaaaacaagagaataataagcccgaatttatttagggtgcaaactatatctgttgtgaaatatggtaatgcgatagttcgtgattttaaattcagacatcatctagaaacgacagtagaagataaaaaagagttgcaaggaaaaacttaccaacaaattaaaagtttgtcacctttgaatgatatcataaaggttagaatcaatcatttaggagatattgttagtgtaggagaatattaa

SEQ ID NO: 5 - DNA, 4608 bp, Ornithobacterium rhinotracheale
atgaacactattctaggattagaccttggaaccaacagtattggatgggctttaatcaaagttctaaatgacaaaactagattacctttagaaattatagatctcggtgttgttgtgatacctacagatcaaagaactttagacaaattttcaaaaggcgaatctatctctaaaacagctgaaagaacaaaacaaaaaggtgtaagaaagttatatgaaagaaaaaagctaagaagagaaagattgcatagggtattaaatattttaggttttttgcctgaacattattctaaaaaaattgatttcaaaaaacatttaggacaattttttggtaattctcaaccaaaaatttcatatgtagaaaatgaccacggaaaacatgaatttattttcatggatagttacagagaaatgttaaaagaattttcaaaacacaatattaaaaatgtaccatatgattggacgatttactacttacgaaagaaagccttatctcaaaaaatctcaaaagaagaacttgcttgggttattttaaatttcaataaaaaaagaggttattatcaatttagagatgataatgctgatgaaaacaaggaaaataaaattgagaaatactatgctctaaaggtcactaatgtaaaaaaagaagatgctcaaaattatactattactctagaaaatggatggatttataaaaataaaagcaaaatatctttattagattgggttggcagcacaaaagaatttatttcaacagaaaaatttgataataaaggaaatataattaagaagaaaaatggtgaagatgatagaactttaaaattagttgattcagaaaaagattggattgctattaaaaaaagtacggaagatagaattgaaaattacggaaagacagttggaacatatctttatgaacatttattaaaggatcctaaccaaaaattaaatggagaacttataaacattatagatagaaagttttacaaaaatgaactaaaacaaattttagagaaacaaaaggaattccaccctgagctactaaatgaagatttattccaaaaatccatcattgaattatatccaaaaaatagtacaagacaaaaagaacttaaaaataaagatttatgttatttactcattgatgatgtaatttactatcaaagagatcttaaaaagaaaaactccacaataaacaaatgtagctttgaaagtcgagaatattatttgaacggagaaaaacaaattcaaaaaataaattgcattgcaaagagcaaacctctatatcaagaattcagaacattacaatttatcaagaatttaaaagtttatgaaattattgatgggcttgagaaagatatcacaagtaagttattacctgattttgaaacaaaagaacatttttttgaatggttaaacgataaagagaaaatagatcaacttcaattattatcctacaaatgttttgacttgcatgacaatgttaaaaatgatctaatagcaaaaggtatcaaaaggcctacagaaaaagcaattagaactgaacttcttgaaaaatacagatggaattattcaaaagacaacgatagaaatttcttattaaatgagactcgttttaaaattttaaaatatctaaaaaaagttgacaaaaaactcacattaacgaatgaacaaattgaaagtctatggcttttgctctattctgcaaaagatgaaagagaattaaaaaatggtcttcaaaaattctcagaaaaaaataaattacctaaaaaattctcagatatctttatctcatttcctcctttcaaaaaggaatatggtgcgtattctgaaaaggcattgaaaaaattacttagtttagttcgatttgggaaatattggtcttttaacaaaattgacaataatattcaaaataagattatgaacatacttaacggagaagtggacgatagcatctctgacagagtacgagaaaaaacaatcttattacaagataaaaatgatttccaagatttaccattatggctagcttcatatgttgcttataatagattttctgaggtttcggaaattaaatattgggactctcccgataaaatagaatttttaaaacagcactctattggaaatccaatcgtagaaaaaataatcaacgaaacattgaagttaattaaagatatatgggtcatacacggaaaaagttgtaaaaatttcttctctgaaatacatattgaacttagtagggaaataaaatctagttcaaaaaaaagagctcaaataactaacaacaatacaaagaatcaaaaattaaacaatttaattaaatcactacttatagagatggccagcgatactaagtatgagaatgtaactccttattctccatctcaacaagaaattttaaaaatctatgacgaaggtatttactcaaaagaggaaaactctgaaaaaattaaggaaataaataaaattagaaacaacaataaaatatctaagtctgatattacaaaatacaaactctggctagaacaaggctatatatcaccttacacgggtaaaattattcccttaactaaacttttcactgcaaagtaccaaaaagaacacataatacctcaaactaaattctttgatgatagttttaataataaagtaatatgtgaagctgaagtaaacaaactaaaagacaactcactagctatgaatttcataaaagctaagggaggaaaagccgttaaactatctgatggagaaacggttacgatcctcaatcaagaggaatataaacaactcgtgaggacatctttcaaaaagaattctataaaattgagaaacttacttttggaagaaattccagacacattcactaaaagacaacttaatgacactaaatatatatcaaaacttgtattatcattgttatctaacattgttagagaaaaaggagagcttgaaagtaccgctaaaagaatagtaagtacaaatggccaaataacatctatacttagaaacgattgggggctaaacaatatctggaacaaattgataactccaagatttgaaaggttaaacaatattaataaaaataaaatttatggtaattgggaaaacaaaaaaggaaaaaatgtatttcaaataaattacttaaacgacaatttatcaactctaaacaccaaaagaattgatcatagacatcatgccttggatgcacttattgtagcatgtaccacgagaaatcatataaactttttaaataatcaatatgcaaaaagtagaaatcaacgacatgatttacgcgctaaattaaaaagaagagaaactattacaactgagggaagtaaaaaacaggtttttaaagattttataaaaccatgggaatcatttacccaagatgcacttaaaaagcttgaaacgacaattgtaaactttaaagtaaataaacgaattataaataaaacaattaattggtacaaaaaatgggaaaaacaaaaagatggtacttacaaaaagattcaaaaaaagcaaacaaagggagatgcatgggctattagaaagccattacatatcgatacaatctatggcattgtatgcaaaaaattgcctttaaaatctgctttagaaaattacaaaaatattattgacgaaaatttaaaacataaaattaaagaacttaaagaagtaaataaattcgacaataaccaaattataaattttttcaaagagtgtaattttatttttgaggacaataacattcaaaaagttgaagtttacgattttaaagataatagagacaaaactattttatcatcatctagacaattgatcgacgaaagctttacacctaaaaaaataggaaaagttttagatccaactatcaggaatattttattaaaacatttaaatagcaccaaatacaataataaatttgattcagatggcaacccaatcaaaccagaaaaacttgctttttcacctgaaggcttaaaagatttaaacaaaaacattaaacacttaaataataacaaagaacaccaaccaatcaaaagagtaaaattatttgaaacattgggaaataaaattaaggttggctacactcaacaaaaaaacaaaaaatttgcagagaccgcaacaggaacaaatctttttttaggaatttattctgacaacaacaaaagagattttaaaacaatacctttaattctagctatacaaagagaaaaagaaggattaaatccatgtccagatacagatgaaaagggaaatcaacttttattttcattatctccaaacgaacttgtttttgttccaaataatgaagaaagaaaaaatccgaatttagttgattttgaaaatctgagtaaggatcagattgatcgaatatacaaatttgtaagctgtactggtagtgaagcttattttgttccttcaagaactgcaaaaccaattattgaaaacgaaaatggaacaaataataaatcccaaagaattatagaatttaacgaaaagacatctataaaaaatgaaaaaaacgagccagttttaatcaaaactatttgttggaaaatagaagtaaatcgtttaggaaaaattattaaagttattaaataa

SEQ ID NO: 6 - DNA, 4323 bp, Weeksella virosa
atgaaaaccatattaggactagatttaggcaccaactctattggatgggcgttggttgaacaagacttcgaaaataaacaaggactgattttgggaatgggtagtcggattattcctatggatgcaggtataatagggaagtttgcagaaggaagttccatctctcaaacggctgaaagaacaggctatcgtagtatcaggagattgagagaaaggcatttacttcgtagagaacgattacaccgagtactcaatattctgaagtttttacccgaacattatgctgctgaaattgactttgagaaacgatttgggcagtttttagcggaaactgaacctaaattggcttggaaaaagaatgctgaaggtaagtttgagtttttattccaacgttcttttgatgaaatggtagctgattttaaagccaatggacaggatattaaaattccttatgattggacaatttattatctccggaaaaaagcgttgactcaaaaaatttctcctcaagaactggcctggattattcttaactttaatcagaaaagagggtattaccagttaagaggagaagaagaggaagaaaatcctaacaaaaaggtcgaattctactcgttgaaaattgtggatgttgtagcagacgaacaacccaataaaaaaggtgatacctggtattctttacaccttgaaaacggttgggtttatagacgttcgagcaaaatccctctttatgattggaaagataaggtgagagattttatcgtaactaccgatattaacgaagatggctcagaaaagttggataaagacggagaggtaaaaagaagttttcgtgctccaaaggaagacgattggactttgataaagaagaaaactgaacaagaaattgaacaattcaatcagaccgtaggtagctatatctatgaagccttattagataaccctactcaaaaaataagaggaaagttagttcgtaccattgaaagaaagttttataaatcagagttaaagaaaattttagaaaaacaaatagaactacaaccagaactgtttacggaagatttatataatgcgtgtgcacgtgagttatatcgcagaaatgtagcgcaccaacagcagttaagtagtcgagatttcgtgtatctttttctaaacgatattattttctaccaacgtccgctaagaagtcagaaatcattgatttccaattgttctttagaatttcgaacaataaaagataaagacggtaatggccaaattatttatctaaaggcaattccaaaatccaacccatattatcaagagtttagagtttggcaatggttgtataatttgaaaatttttaccaaagaggacgataaagatgttacgaatcaatttataaataaagtcgaagatttagaggctctttttgagtttctgatgaaccaaaaagaagtcaatcacaccgatattctaacttatctcatcgaaccaattgtaaaatcgaagtatccaaatgcaaagggtaaagcatttaaagatgaactaaaaaaagaattaaagaaataccgttggaattatgtttatgatgctgataaagatgagtcgaagtcttacccgatgaatgaaaccaggtatgaactcagaaaaagattggataaagtagagaatgttcctgctgattttatgacaagaaaaattgaacaacatttatggcacattatttattcggttaccgataaaatcgagtttgaaaaagcactaaaatcttttgcaaataaatatgatttacatcaggagtctttcgtagaaaacttcaagcgtttcaaaccttttgatagtgattatggaacttattctgaaaaagctatcaaaaaactattgcctttgatgagagttggaaagtactggagttgggatatcattgatgacaaaacgaaaaccagaattggtaaaattattacaggagaatatgatgaaacaataaaaaatagagttcgagaaaaagcgattgatttaactgaagaaaatcattttcaaggtttgcaattgtggttggcacaatacattgtttacgaccgacattccgaagctgacatcgctggaaaatggaattcagttgccgatttagaacaatatttgtctgaatttaaacaacattctttgcggaatcctattgtggaacaggtcattaccgaaacacttcgagtagtaagggatatttggaaacaatatggaaaaggcgctaaagattatttcgatgaaattcatatcgaattgggacgtgaaatgaaaaatacggcagaggaacgcaaacgcttatccagcattatttcagaaaacgaaacgaccaatctccgcatcagagctatactcgaagaattgatgtatgatgaaaatatggaaaacgtgcgcccttattcgccaatgcaacaagaagccttaaaaatctatgaagatggtgtactaagttcaagtgtagaaatcccagaggatatcgaaaaaatcagtaagaaatccgagccaacaaagtcagaaattcaacgatacaaattgtggttagaacaaaaatatcgttccccttatacaggaagaccgattccattgagtaagttgtttacacctgcttatcaaatagagcacattatcccacaggcaaggttttttgatgatggcttttccaataaagtgatttgtgaatctgaagtcaacgcactaaaggataagatgctgggactagagtttattcaaaattattatggccaaaaagtcactaccagttttggagaagtgacaatacttacagaagatgcctacaaagcatttgtgaaagaacactacgacaagaaccgaagcaaacgcaacaaacttttgttggaagaaattccagaaaaaatgatagatcgacaaatgaatgacacaaggtatatcagtaaatatatctccaaagtattgtcaaatcttgttagaggtgaaaaggacgatgaaggagtaaattctaaaaacatcattcctggtaatggaaaaataactggaatattaaaacaagattgggggttaaatgatgtttggaatgacttaatattacctcgatttgagcggatgaatcaattaaccaactccactgattttacagcttggaacgaaaaacatcaaaaatttttaccatcagttccactagagctatcaaaaggttttcaaaagaaacggattgatcacagacatcacgctttagacgcgttaattatcgcttgtgctacacgcgatcacgtcaatttgttgaataataaacacgctaaatcaagaaacgagcgctacgatctacaacataagctgcgccacaccacgccttggcaagacaaggaaggaaaggttagaactaaattcacagagtttaaaaaaccatgggaaacctttactcaggacacaaaaaaagaattggaaaaaattgtcgtaaactttaaacagaacttacgtgttatcaacaaagcaaccaattattatgaaaagattgttgacggtaaaaaagtaatgttcaaacaagaaggggtgaattgggcaattcgtaaaccaatgcataaagaaacggtttcaggaaaaattgatttacccagagtaaaggtgtccaaaggcaaaatattgactgcgaccagaaaatcactggatacatcttttaatgctaaaacaattttatccattaccgatacgggaattcagaaaattttgttgaattatttaaaagcaaaaggaaatcctgaattggcgttttctccagagggtattgaagagatgaatcaaaacatttcattatataatgatgggaaaccacatcaacctattttaaaagttcgtgtattcgaacagggaagtaaattcccattgggagaaacgggtaacaaaaccacaaaatatgtggaagctgccaaaggaactaatctcttttttggagtatatgaagataatcaaggaaaaagaagttatgataccattcctttgaatattgttatagaacgacaaaaacaaggcttaaattctgtgccagaaacgaatgaaaaaggtcatcgcttattgtttagtttgtcgccaaacgatttggtttatgtgccgatcgaaggagaggtttttgatgaaactaatcctgatgtaaatagaatttataaagtagtgagcttcagtggaagtcaaatgttttgtgtaaggcaagatgtagctacatcgattgtatataaactagaattttcctctctaaacaaaatggaaagaactatagatggtataatgataaaagaaatttgtatcaaactcaaagtcgaccgtttaggtaacatttcaaaagcttaa

SEQ ID NO: 7 - DNA, 4038 bp, Flavobacterium frigidarium
atgaagaaaatattaggattggatttggggacaacctcaataggatggtcgtttataaatgaatcagaaaatgaaaatgaaacttcatcaatagtaaatacaggagttcgtattgtgccattaacttcagacgaagaagctgacttcaaaaaaggcaatacaatttctataaacgctgatagaacattaaagcgtggtgcgagaagaggattgcaacgttttaaattgagaagagatgcattattagatattttttctaaaataaatttcattcccactcattatgtttatgctgaaaatggttcgaacagtacttttttatcgtatcaattacgtgcaaaagcagctattgaaaaagtaagcaaagaagaattagtacaagttttattaatgctcaacaaaaaaagaggatataaaagtagtcgtaaagcaaaatctgcggatgaaggcgatgcgattgatggaatgaaaattgccaaagaaatctttgaaaacaatttaactcctggtcaatgggtttataactcactattaaaagagggaaaattcatccctgatttttatcgttctgatttacagaaagaattagagagaattgtacgttttcaaaatcaatttcattcggaacaaatgaatgaaaaattgttggaagatattcaaggaaaaacaagaacccaaacttcgcaatactttaccaacgcaataaaaattccacttaccgaaaataaaggttcgagagacgaggtaaaactacagcattacaaatggaggtctgaagcattgactagcgaactggatttaaaaatcctagcatacgttattactgaaattaacaatcaaattaatcagtcgagtggttatttgggagctattagtgaccgaagcaaggaactgtattttaatcaagaaactgttggacaataccaatacaaacaactacaagaaaatgcacataataaactaaaaaaccaagtattttatagacaagattatttagatgaatttgagaaaatttggaaaacccaagcaagatttcatcctgaattaaccgataaactaaaaacagaagtatgtgatattacgattttttatcaaagaaaattaaaatctcagaagcatcttgttagcttttgcgagtttgaaaaaggccacaaagccattccaaaatcatctcctctatttcaagattttagaatttggcagaatttgaataacattgttatcaaaaacgaaacaaccaaagaaccatttgttttagacgaagatttaaaaaaaatcatttcagaagaattactttttaaagaaagcatgaccgatgtgcaaatgatggccttttgcgatttaaaaaaaggaaaccattctgccaatttcaaaaaaatagaagggaatagaaccaatacagagatttttaaagcttttgagaaaattttaattctcgaaggctacgacgaattggatttttctaaactagatgcatcagatatcaaacaaatttttaaatctgcttttgttgatttaggaatcagtacagctatacttcattttgacccaaaaattcaaggaaatgattttgataaacaaggatattaccaattctggcacttgctatatgcagcagaagatgacgataaattgaaagaaacgttaaaaaataaatatggatttaaagaaaaccaccttccttatctattgaatattaatctacaagctgattatggtagtttgagtgccaaagctattaaaaaaatattgcctcacttaatggatggacatatttataataaggcttgtttaatgagcggttacaatcactcctcctcgctaactaccgaacaaaataatgatcgtgttttaaaagacacacttgaattattaaaaaagaacagcttacgtaatccagtagttgagaaaatactcaaccaaatgattaatgtaatcaatgctattataaaagaccccgaaatggggaaaccagatgaaatcagagtagaactggctcgagagttaaaagcaaacaacgagcaaagaagtgatatgacaaaggctatcaataaaagtacagccgaacacgacaaaattagacaactactccgtaccgaatttggaattcctagagtaactagaaacgatattataagatacaaactgtggaaagaaacagaaggaatttcgatatatacaggcaaaaccattgaagcttcgagattgtttaccaaagactatgatattgaacatattataccaaaatcacgattatttgatgatagcttttcgaataaaaccatttgtgaacgccagctaaatattgataaaagtaataaaactgcttattcttttttacaagaaaaattatctgctgaagattttgaccaatttgaaaaaagagtaaaaagtttgtttggtaaaataagtcgcaccaagcaaaacaaacttttgatggcagacaatgaaattccagaaggttttattgaccgtcagttacgagaaacacaatatattgcaaaaaaggctaaagaaatattattcgaagtttctagaaatgtaaccgcaactattggtagtgtaaccgacaaattgcgtgatgattgggaattagtagaagttatgaaagagcttaattggaagaaatacgaaaaattgggtctaacctatgaagaaaaaggcaaaaatggagaacgcctatacaaaataaaagactggactaaaagaaacgaccaccgccatcatgcgatggatgcgattacagttgcgtttacaaaacctgcttatataaagtatttgaatacattaaatgcgcaaagtaaagatgatactaaagaaatatattcgcagtatttaaaaagagacaaaaataataagttgcgtttcatccctccgatggagaattttagagaagcggctaaaaagcaacttgaaagtattttgatttcgtacaaagccaaaaacaaagtagttaccaaaaataaaaatacaaccaaaaaaagcggaggaacgcaaacaaaaatacaattgacaccaagaggtcaattgcataaagaaacggtatatggtaaactacagcgttatgaaaccaaagaagagaaagtaaacgccaactttacagcggctcatattgcaaaagtggccaataaagcctaccgtgaagcactcttaaaacgactggaagagaatgaaaatgatcccaagaaagctttcacaggtaaaaattcattggcaaaaacacctatctatattagtttaaaagataacattactgttcccgagaaagttaaattagtctggttagaagacaattacacgattagaaaagacattacacccgataattttaaggatttaaaaagtattgctaaagtaatggactctggattaaaaactattttagaaaaccgtttagccgagtatggcaatgatcctaaaaaagctttctcaaatcttgacgaaaaccctatttggcaaaacaaagaaaaaggaattgcgataaaacgggttactattagtggcgtgagcaatgctcaggctttgcataccaaaaaagaccatttgggtaatgaaattttggatcaagaaggaaaaccgatgcctgttgattttgttagtactggaaacaatcatcatgtggccatttacagagacgaaaaaggaaatctacaggaagaagtagtttcgttttatgatgcagttatcaggcgtaatctagggttatcggtaattaataaaaaccatgaaaaaggttgggactttctattctccatgaaacaaaatgagttttttatatttccatctgatagctttaatcctcatgaaatggatttacaaaacccaactaattatcatttgattagtcgttatatattccgtgtacaaaagattgccacaaaagattacacatttagacatcatttagaaacaactgtagaagacaaaaaagaactaaaagatatttcatctaaacgattaggattaaacggaataaatgacattgtaaaaatccgaattaaccatttggggaaaattgttcagataggagaatattaa

SEQ ID NO: 8 - DNA, 3642 bp, Rikenellaceae sp.
atggagaaaagattgggtatagatgtaggaaccaattccctcggatgggctatcgtggaggtggacgacgaaggatgtacgctgctcgaccgaggggtggatatctttcaggagggggtagcacgtgagaagaatcaggagaaaccggccgtgcaggacaggaccgatgcccgtgccctacggcggcactatttccgtcgccgtttgcgcaagatagccctgttgcgggtgttggtacggcacgacctgtgtcccgcattgtcggaggagcagttgaacgcctggcaggggaaggggatttatccgttggacgatgcgttcatccgttggcagcgtaccgacgacaatgcggacaggaacccgtaccgcgaccgcttccggtgtctgaccgaagaactcgatttggcctgccgcgaagaacgttacgtgctgggcagggcgctgtatcatctgtgtcagcgccgcggatttctgagcaatcgcaaggatgcgggaaacgaggccgaggagggtaaggtgaagcaggagattaaaaccctctctgccgacatggccgctgcggggtgcgaatatctgggcgaatatttctaccggctttaccagcggaaagagaagattcgcaaacactatacagcccggaacgagcactatctggccgagtttcgtgccatttgccggaaacagcggcttgatgaggagttgcgacaggcattggaaaaagccattttctatcagaggcccctcaagtcgcaaaagggcttggtaggcaagtgtactttcgaaaaggacaagagccgctgtccggtgtcccatccgcgcttcgaggagttccggatgctccagttcatcaacaacgttcgggttacgggtcccggcgatgcggagccgcggcccctttcgccggaggaggtggagattgtccgtccgctgttcctgcgcaagagcaaaccgcatttcgatttcgaagacattgccaaaaagatagcgggcaaagggaactatgcctgccggggcgagttgctgcaggcgccgtaccgcttcaattgtgccggcaaatcgacggtgacggggtctcccgtatcggcccttttcgcttcggttttcggagatgattggcagcgtgagatttgcagcctgtatacgctcggtgccgggaaaaacgaggagcagatactcaacgacgtatggcatgtcctcttcgcctttgaggacgaggagcggttgcaggcctggttgcaggagaaactgcagctttcggccgacgatgcgaaaaccctggcggccttccgtctgccgcaggggtatgcgtcgctgagcctgaacgttatcaacaagatacttccctacctgcggcgcggataccgctacgacgaggcggtattctttgccaacctcggaaaggtgcttccggcggaggtgtatgccgacccggccaggcgccgcgaagtggagcaagggatttccgcccagatggatgatttgggcgacggagagaaaacacggaaggaggaacgtattcgcgattatctgcggcgttattggggcgtagaggagaagcggctggagcgcctttaccatccttcgatgattgaggcgtatccgtcggcgtctcccaacggacagggtctcctgcagctgggttcgccgcgcatcccggctgtccggaatccgatggccatgcgagctctgttccgcctccgcgtactgctgaacgaactcctgcgcgaaggaaagattgaccgtggcacgaaaatcaatatcgagctcgcccgcgagctgaacgacgccaacaaacggaaggccatcgaacgttaccagcgggagcgggaggctgagaaccgcaaatatgccgaagagattcgccaacagtatgtcgaagcgacgggacattccatagagccctccgaagaggatattctcaaataccgtctgtgggtggagcaggggcattgttccctttatacggggaagacaatcgggatttccgagtttctcggcgacggccggcggtacgacatcgagcataccgtcccccgttcgcgtgggggagaggatgcgcagtacaacaagacgctgtgcgaagaggaattcaaccgggatataaaacgcgacaaactgccgtcggagctggccaaccataccgcgatattggcctgtgtcgagtcgtgcggatggttcgagcgcatcgaggggttggagcatcgggtctggggggcggaccgtcgcgcaaagagtgcgacgaccaaatcggcgaaggatttcgccattcaggaccggcactactggaggatgcacctcgattactggcgcaggaagtgcgaggcctttaccatgacggaggtgcccgaaggattcagcaatcggcagggtgtggatgttggcatcatcggccggtatgcgcggctctatctgcagacagtcttcgaccgggtttatacggtcaagggtgctacgacggctgcgttccgcaggatgtgggggctgcaggaggagtatgcggcgaaagagcgcgtgaatcatgtccaccactgtatagatgccattaccatcgcctgcatcggaagccgggagtacgccttgtgggcgcagtacgttcggcaggatgaactctatcggtggggggaagcggataaaccccgttgcggcaagccgtggccgaccttcaccgaggatgtccgggcgacggccgatgagctgctcatttcgcatcacacacccgacaacatgcccaagcagagtcggaaacggctgcgtgtgcggggaaaggtgcagcggaacgacaggggagaggtcaaatacatgcagggcgatactgcccggggtgctctccatcaacagacattttatggagccatcgaacgagacggcgagattcggtatgtcgtgcgcaagtcgctcgaccaactgctgcctgcggatgtggaaaaaatcgtggatgaggcggtcagacagaaagtcagggaggcggtcgaggcatacggtttcaaagaggcgacagacccgacgaaacacaccgtctggatgaacgaggaaaaacagataccgattcggaaggtgcggatattgaccggtgtgaaaaatccgattctcctgaagcctcatcgcgatgtatccgttaaggagtataagcgatattaccatgtcgtcaacgacgggaattactgcatggcgatttacgaaggcagagacaggcagggcaggttgaaacggacgtttgaaatcgtcaataaactggaggcggcccgttatttcaaacggagtgcggaccgggaatcccggcccgatttggtaccgctgtcggatgtcaacggttattcgcttaagtatctcttgaaaacggggacgatggtgttgttttatgaaaattccccggacgagttgtatgaatgttcggtcggagagttggctaaaaggttgtacaaggttgtgggaatggcgcaggatggtcgtgtccagtttctgtttcatcaggaggcacgggaccagaaagccgttacggcggagtgtggaatgggaatttcggttttcgatgcacgccatcctgctccgaagttgaggataagagtttccaattttaaaatgttcgtcgaaggctatgacttcgaactgacggttacgggggaagtaaaattcaaacggtaa

SEQ ID NO: 9 - DNA, 4380 bp, Jejuia pallidilutea
atgtcaaaacttggattagatttaggaagctcatcggttggttgggcaaaaaatgtaggtggtaaaattgtaaaaagcggtgtaattacttttaatacaggaatgtcaaaagggcaatcaggtgggtatgtttctccaactagagaaagaagagaagcacgtgctaagcgaaacttgattaagtcaaggaaataccgaaaatgggaattattgaaagttttggcagaaatgaaatttgttccattggatgagcaagagctacaaatttggagcaaatacaaaaaaggcagcacacgtaggtttcctgaaaatgaaaaattcttaaagtggttggcttgtgactttacgtatgaagaaggtgaaaactataaaaacccatatgtattacgagtgaaagcacttaaccatattgtaactaagcatgaatttgggcgtgcattataccatattgtacaacgtagaggctataaagatattggagaaaccgataaggaaactgaaaaccaaattaaaagaaggaatgacgatggttttaaaaaagctttagatatacacggtactgtcgctaaagcattaaatgaagaatttcttaaaaagggaaaaagagcaagaaaccagtatcctcttagggaggaatataaacacgaattggaggaactatgtaaagctcaaggatataatatacaaaaagaagggaaagaaggttataaaaataaatttgtaaaaagtttatggaaagccattatttggcagcaaccactgaaaactcaaagaggcaatattggcaaatgttccttagaacctacaaaaccaagaagtccgatttcacatcctatttttgaaatatttagatcttggcaatttattaacactattagatattatgatgatgatggagaaaaacaagttttatcccaaaaaataaaacaagccctattttacgagaaattcttaaaaaaagattcaaatttcaaatttgaagaaatcagaaaatttcttgacaagagatttcaaaaagcaaagagatacaattacccaatagacagaaaaacaggaaaatatgatacttctgtttcgggaatgcctgtttgcaaagggcttataaatgtctttggtgaaaaagcacaatctgcacttgacgatatggaattgtatcaaatcaataacgcacctaaaattattgataaatattcaatatatgatttatggcatatcatattcgagtttgatgcagaacatcttgataagtttgcaaccgaaaagctcaaaattcagaataaaatagtaacaaggaaaaagaaacaaatttcaatttccccattggtagaattaaaagagaagtttattcagggttacgcagatttaagtttaaaagctctatgtaaaattataccatttttaaagaagggtcacttatataatgatgctgttattcttgctaaaataccagaattgctagatacacaatggcaagaaaaaagagatttgataaatgaagtattagagaaaagtaacaaactatacaatgaaagaaaagcaataatcaatattgcaaataatttgattgataagcataaggggttaaatcactctgaaaaatttgcatacaaagattttgaatatgctcttgtacccgacgatattgaggaaatcgaaaaagcttgtgtagggtattttggagaaaaatcttggataaagaataaaaaaaaggaagaaatcataaaagaagttggatttgaatatcaagactacttccacgacacgaaaagagcttatcgtaaatttccaaattttacagaaattttcaaagatgacttaaaagaaaatggtattaatttgaaaggcgaattatatcatcattccaatcgcaaaaatatatatgataatacactagaaataaatcatgaaacaggagaaaaatacttgccaacttataaggatactggaatagaaatattacctgttccatatatagatagtataaaaaaccctatgttcaataaatcgatgagcatattacgaaaattgattaatgagttgattgtagctggtgaagttgatgataacacagagattattgtagaacttgcacgggagctaaatgacaacaataaacgtgcagcaattgaacgctatcaaaatctacgaaaaaataaccgagaaaagtaccgggagtttttaaaagaatttaaaaatagagaaaacatcaatctaaatgttgaagaaagtatttcggcttttgaactatggtcagagcaaacgtttgaagaaactaatgatgaaaatggaaaaaggatatcaaacaaaggccatattgaaatattaaatgaaaaagcagctctaaaacgatacgaattatggatggagcaaaaaggtcaatgtatgtacacagggaaaatgatttcaattacacaattgttttcaaatgatatagatattatgcacactattccacgttggttgttgccagataacacaatggcaaatatgacagtaggattttctaaatataatcgtgatttgcaaaaagaaaagttgcctaagcaatgtgataactattctgtagatgtagatgggtggggaacaagtattgaacctaggttggaaatatggaagaaagagcgagataaatggaaaagtttatttgaaagtagaagaaaaccaaaaggtaatgaagatgaagagaagaaaaacaaacgaattcaggaaaagcactattttaaaatgcaccttatttattggaatgataagattgagcgttttgaagcagatgaggtaaaagatagttgggcaagaaggcaattagtcgatactcaaatgatcagcaggtacgcacgtgaatatcttaaattatattttaaaaaagtctccgtacaaaaaggtacagtcacatccgattttagaaagttgttcggatttcaagaagaggatgaaataaaaagtcgtgataaacacacacatcacgctattgatgcatcagttttaaccttgattcccgttaacagtagtaagagagaacaaattttaaaaaattattttaaaagtcaggaggacaaagataaattgagccttaaaaaactcagagccagtgtaaagccatcttctgattttaatcctcaagaattgataagaaaaatagaagaaaaaacactaattgttaattaccaaaaagacaaaattataaaccaatctataaaaaaagtaagaaaaagaggaaaaattcaatatgtcaaagataaacaaggagaatttgtattggacaaagagggtaacagaatcattaaatatgctaaaggtgatactcttaggagtgaattgtttgcacaaacctatttaggtaaaataaaagatgttgaaagatatgatgatagtagcccaaaacgaaataccgaaaatactgattggatatataaaaaagggaaagatgaatttatttttgtcaaaagagaaaatatagataaggtaaaatcatcagataaattgattaaatcaataatagaccctgttattagaaatttagtagaagaacagaaaaaaaacactattgtaaaagattatcaaggtaacgtaattcgtcatattagaattagaacaaaatcaggtagggaggtgaaagaacgaataaattaccgttcacgatacgactacaaaaataaattttactctgaagctggaaaaataccatatgccgtattacttcaaaaaagcataaatggagaaatagaaagagaaatgattccagtagcttcttttgaagtagctaaagtatttaaaaaacatagaaagtttaatccagaactttacatgaatgagtttcatccagatattggaaattgggataaaaaaaattggcttaaagttggacaaaaagtaattgttttaaagaatgataaagaatttgaaaaaagggatgacattgattttcaacataagagaatgtatgtaataacacagttttcagatggaggaatttggctacaataccatttaaatgcacaatccaaggatgatgtaaaaaaatctataagccttgcaaaagataagttgcttcgtaagtatgaaattcaatataatattcctgaggtaattgaagatgaatccattcaggacagaaaaaatcgtactgctgattataataataggaggtttagatttgatacaattagtaaaagttttaggctaacaacattaatggaaacgattggagaaaaaagaacaaaaaaaataaaagcagaattagacaaatataaagcgattccatctagtattgagattgaaggtgaaacggctttattgaaaatgtcaaaagaaaactggaattacctttatgagggtacagactttgaagttacaattttaggtaaattaaattggttgtga

SEQ ID NO: 10 - DNA, 4329 bp, Caenispirillum salinarum
atgcccgtcctgtcaccgctctccccgaacgcggcacaaggccggcgccgctggtcgctcgcgctggatatcggcgagggcagcatcggctgggcggtggcggaggtggacgccgagggccgggtcctccagctgaccggcaccggcgtcactctgttccccagcgcctggagcaacgagaacgggacctacgtcgcccacggcgccgccgaccgcgccgtgcgggggcaacaacagcgccacgacagccggcgccggcgcctggccgggctcgccaggctatgcgcgccggtgctggagcgctcgccggaagacctcaaggacctgacgcgcacgcccccgaaggcagacccgcgcgccattttcttccttcgcgccgatgccgcccgccggccgctggacgggccggagttgttccgcgttctgcaccacatggcggcccatcgcggcatccggctggcggagcttcaggaggtcgacccgccccctgaatcggatgccgacgacgccgcgcccgccgccaccgaggacgaggacggcacccgccgcgccgccgccgacgaacgcgccttccgccgcctgatggccgagcatatgcaccgccacggcacgcagcccacctgcggcgagatcatggccgggcgcctgcgcgaaacgcccgccggcgcccaacccgtcacccgcgcccgcgacggcctgcgcgtcggcggtggtgtcgccgtgcccacccgcgcgctgatcgagcaggagttcgacgccatccgcgccatccaggcgccccggcacccggacctgccgtgggacagcctgcgccggctggtgctggatcaggcgcccatcgccgtgccgccggccacgccctgcctgttcctggaggaactgcgccggcgcggcgagaccttccagggccgcaccatcacgcgcgaggccatcgaccgcggcctgaccgtggacccgctgatccaggccctgcgcattcgcgaaaccgtcggcaacctgcgcctgcacgagcgcatcaccgagcccgacgggcgccagcggtacgttccccgcgccatgcccgagttgggcctgagccacggggaactcaccgcgcccgagcgcgatacccttgtacgcgccctgatgcacgaccccgacggactggccgcgaaggacgggcgcatcccctacacccgcctgcgcaagctgatcggctacgacaactcgccggtctgcttcgcccaggagcgggatacctccggcggcggcattaccgtcaatcccaccgacccgctgatggcccggtggatcgacggctgggtcgatctgccgctgaaggcgcggtcgctctatgtgcgcgacgtggtggcgcgcggcgcggactccgccgccctcgcccgcctgctggccgaaggggctcacggcgtgccgccggtcgccgccgcggcggtgcccgccgccaccgccgcgatcctggaaagcgacatcatgcagccgggccgctacagcgtctgcccgtgggcggcggaggcgatcctggacgcctgggccaacgcgccgaccgaaggcttctacgacgtgacgcgcggcctgttcggcttcgcacccggcgaaatcgtgctggaggacctgcgccgcgcccggggcgcgctgctcgcccacctgccgcgcaccatggccgccgccagaacgccgaaccgcgccgcccagcagcgcggccccctgcccgcctatgaaagcgtcatcccgtcgcagctgatcaccagcctgcggcgcgcgcacaagggccgcgccgccgactggagcgccgccgaccccgaggagcgcaaccccttcctgcggacgtggacgggcaacgccgccaccgaccacatcctcaaccaggtgcgcaagacggccaacgaggtcatcaccaagtacggcaaccgccgcggctgggacccgctgcccagccgcatcaccgtggaactggcgcgcgaggccaagcacggcgtcatccgccgcaacgagatcgccaaggagaaccgcgagaacgaaggccgccggaagaaggagtccgccgcgctggataccttctgccaggacaacaccgtgtcgtggcaggcagggggcctgcccaaggagcgcgcggccctgcgcctgcgcctggcgcaacggcaggaattcttctgcccctactgcgcggagcggccgaagctccgcgccaccgacctgttctcccccgccgagaccgagatcgaccacgtcatcgagcggcgcatgggcggcgacgggccggacaacctggtgctcgcccacaaggactgcaacaacgccaagggcaagaagacgccgcacgagcacgccggcgacctgctcgacagcccggcgctcgccgccctgtggcaaggctggcggaaggagaacgccgaccgcctgaagggcaagggccacaaggcgcgcaccccgcgcgaggacaaggatttcatggaccgcgtcggctggcgcttcgaggaggacgcccgcgccaaggccgaggaaaaccaggagcgccggggccgccggatgctccacgacaccgcccgcgccacccgtctggcccgcctctacctggccgcggccgtcatgcccgaggacccggccgagatcggcgccccgcccgtggaaacaccgcccagccccgaggacccgacgggctacaccgccatctaccggaccatcagccgcgtgcagcccgtcaacgggtcggtcacccacatgctgcgccagcgccttctccagcgcgacaagaaccgcgactatcagacccaccacgcggaagacgcctgccttctgctgctggcggggccggcggtcgtccaggccttcaacaccgaggcagcgcaacacggcgccgacgcccccgacgaccgtccggtggacctcatgcccaccagcgacgcctaccatcagcaacgccgggcccgcgccctgggccgggtgccgctggccaccgtggatgcggcgctggccgacatcgtcatgcccgaaagcgaccgccaggaccccgagaccggccgggtccactggcgcctgacccgcgccgggcgcggcctgaagcgccgcatcgacgacctgacgcggaactgcgtcatcctttcccgcccgcgcaggcccagcgagaccggcacgccaggcgcgctgcacaacgccacccattacggccggcgcgagatcaccgtcgacggccggaccgacacggtggtcacccagcgcatgaacgcgcgcgacctggtggccctgctggacaacgcgaagatcgttccggccgcccgcctggacgccgccgcgccgggcgacaccatcctcaaggaaatctgcaccgagattgccgaccgccacgatcgcgtcgtcgaccccgagggcacccatgcgcggcgatggatttccgcgcggctggccgccctggtgcccgcccacgcggaggcggtggcgcgcgacatcgccgagcttgcggacctggacgccctggccgacgccgaccgcacgccggagcaggaagcccgccggagcgcactgcggcagtcgccctatctcggccgcgccatcagcgccaagaaggcagacggccgcgcccgcgcccgcgaacaggagattctcacgcgcgcgctgctagacccgcactggggcccgcgcggcctgcgccacctgatcatgcgggaggcgcgcgcgcccagcctcgtgcgcatccgcgccaacaagaccgacgccttcggccgcccggtgcccgacgcggcggtgtgggtgaagaccgacggcaacgccgtctcgcagttgtggcgcctcacctcggttgtcaccgacgacggccggcgtattccgctgcccaagcccatcgaaaagcgcatcgagatcagcaacctcgaatacgcccggctcaatggcctggacgagggcgcgggcgtcacgggtaacaacgccccgccgcgtcccctgcgccaggacatcgaccgcctgaccccgctgtggcgcgaccacggcaccgcccccggcggctacttgggcacggcagtgggagaactggaagacaaggctcgctcggcccttcgtggcaaagccatgcgccagacgctgaccgacgctggcatcacggccgaagcggggtggcggctggacagcgagggggcggtgtgtgacctagaggtcgcgaagggggacacggtgaaaaaggacggcaagacctacaaggtcggcgtcatcacgcaaggcattttcggcatgcccgtcgatgcggcgggaagcgcacccaggacgcctgaagactgcgagaagtttgaagagcagtatgggatcaagccgtggaaggcgaaggggattccattggcgtga

SEQ ID NO: 11 - DNA, 4377 bp, Salinispira pacifica
atgccttacacccttggattggatttaggtagcagctcccttggttgggcgctggtggatgaagaacaacagaacataatcaagaccggagtgagagttttccctggtgctgccacggatattggaaccgggaaggaatcatataagaaccaggatcgccgtttatcccgccaggctcggagacagacactcaggagaaagcagcgtcgaatagtcttattgagaacactcgtagacttcaaaatgtgtcccttgagcaaagatgaacttgaaagttatgcaaaataccggaaaggaaagaaacaagaatttccatcctcatccgaatttaattcttggttaaaactaaatccatacgagttgagagatagggcattgcatgaagacatttcccggttcgagtttggaagaatcctctatcacataattcatcatagggggttcaaaaccggacgtaaaagtaatgaagatggtgctctatacaaagggaatgaagacaccgtcggtgtagatgagacaaaaaatcttcttcaacaatatgcaacccttggtgagtacttgaattcactccggattaagtctgatggcaatgaacgattacgagggcgttacaccctccgcaactggtatgtagacgaattcaataaaatttgggaacgtcaggcaggaaagcttggacttgaaaatgagactgtacatagcagaaacaagcggtactacggaccagccgggagcagtgaacacaggcgcaagcttcaagcatataaaaaggctggaatttcgttcgaaatcgagggtgattttatctgccgcgaacaaactgtgagcttgaaggattaccttggcaatccagacaaaggaattcttttctaccagaaaccattgaaatcgcaaaagcatctcctgagcaaatgccgctacgagaaaagaaagtcagtatgccagatatctcaccctgagtttgaatactacagagctatgcaatttgccaatcaaatcgagtacggagcgggggaaaaactaaacgagactgatcgcaaagatgtaatcattcttcttctctcaaaagataaagcagttaagatgagcgatttaaaaaagaagattcaaaaaactggagtgcaattcaattatgcagatgatcataaagttcccggcagcccgacaactgcctttatttccaaggtgacggacacttctaacgttgaaaatattgattgggaacttttccattctatctggaacgatctcgtgttctacgataaaagcgaaaaactcaaagagaagtttcaaagaagctataacattgatgtttccattgagcagcttaacaaatacaagataaacaccgattacagctcactctctctgaaggcggtacgaaatatcaatccatttcttcagatggggatgctttacaatgacgcagtaatatttgccggaatcaggcgtgtgataggtgaaaaatcatttgatgcaaatgctgatgaaatcatttcacacgtttccaaattgaaagaaaaaaataaccgggatgtgaaccaaagtttcactgatgcgcttcgggaatatgttatgcagacattcaacatttccatgaatcagacgtataagttgtaccatcacagtcaggagatgagtgtccagaacaatcgttactatctcagtgaactaccaaaccttcgcaaccctattgtacagcaagcattgcaggaactgcgaacactcgttaacactctcgtagagcaatatctccctgacggagagcaattcagtaaaatcaaagtggaacttgcccgggaattgaagctcccgagagatgtgcgcagacgaatgcattgggagaataatcagcgggcagagcgaaacaacgatgcaaaaattgaactgcaaaaattcggtctttcacccagccgtgaaaatatccaaaagtatattctttacaaggagatacagaacagcgttcaaggtcaaagtgttcaatgcccctacacaggtcaatccttggctataaccgatgtatttggtaacgacaacaaggttcaagtagagcacataatcccatatagtatttccctggacgacagcctgagcaataaaaccctttgcatcgccgaagaaaatggaaaaaaaggagagaaaacgccgtaccagttttataaatctgatcccgatcactgggaagtagtgaaggcaagagcctttacacttctaccttacgaaaaagcaaagcgatttgtatccacccgtgattacgagccagaagcatttttacagagacagctcaatgatactcgctacatcagcaaggctgcacgggattatctttccacaatttgtgatcaagtctatgttttcccgggcagcttgacagcaaaagtcagaagaatgtgggggctaaactcaatactatcacctccaatcaaaaccaatttcgaaggaaatgcaggaatgtattgggcggtaatgaatgacgacggggtcattatcgaactaagcgaacaggaactccctcctccagcgatacgggcatctgatatccttataagtggagaaatgaaaaacggcatattcaaagttgatcgtaaatttacagggcaaagccaaacacgagaagtaagtgtagagcatcgtacatacgattctcccgggtggatggtttactcactattatcagttgaaaaatatctccctttattctcaaaactaccctcacaagataccaaatccatctggctgaaaggccgtgctcaggtaaaagatcgcgagtcaccatctctcatgttgaattccttgcctgttaaactgatgcttccccctggagaatatgatgataatgccccatattgggtgaatatacccgtgaatggagaacttcgttgggagaagagaggggaaaagccgggtaaaaatgagctattgattaaacgaaccaagcatagggatggaaaagttgaagcttttatcgacaaacgaaagtgtctgttcgatatcccccctcaagataataaatctgctttgattatcccattagaccttcaggagatacttcaggtcgtgcggatgtttacacctactcctgcaatagcggaacatcagttcctcattaagggtaaaattgaccaaagctacagatttaccgcggaaagcaatttcagaatagctttggatgctcctgaaggaaccccatccggccccgcattcgctatagctaactgtgaaccacgggatatgcgtttttatccgaaaaagaacataaaacctaaaaacggaaagggaaaaaatgtcctttccggttttgtgttccaggaagacgggagtcttgtatttaaccccggaaaaaaccgtatggatcatcgacatcacgccatagatgctctgacaatagccctactgaatacggggcagttgcgggaacttagcggatattttttaaagatcaagaaaagacagcgctacagcgctcctaagccacagttcccgttaccctgggacaactttcgagccgatgcattaaattcaattaacagcattctggtggttcatcgccaaaatagggaaataatcaagagaataaaaaagaacacaagacttaatggacgcacatatgtatcccaaggcatgagtgtgcggggtcaactgcacaaggacactgtttacggtaagcactatataccgggaagtgatgaaccgggataccacgttcgaaagcaaataacagatttgacttctctgagtaaaattgctgatgctggcacacatgaaattcttcgaacgttcgtcgaagaaaatggttactccattgatgagaaagaaaaagtaaaaggtgaatggtttacaaagggtaatgattaccaggttataatgccaagctccggtaagcccggaaatccaataaagaaggtgagaatcagggagaacctgggtaatgcagtgcaatggcatacaggtataaaccagtacgtgaacccacgcaataactacgcattcatcatataccgtgattcagacggcaactataaagaacacccggttactttctgggatgctgttcaggcaagacttgctgggaaaagcgtttatcagcttccggaacccggtaagattattaccacccttcacataaacgatacgtttttgcttggattaggtgatgagcagctgcagggagatcttccccaggagcttgtctcacggcatctataccgggtacagaagttgtcttcaatgtattactgcttccgccttcatacagaaagcacattggatcgagattttgagccgtactacctcgggatacaaagcttcaaagcttggaaggaacaaaatccgttaagagtcaaggtagccaccaccggggaggtgaatttagaatga

SEQ ID NO: 12 - DNA, 3213 bp, Sulfitobacter donghicola
atgcgtttgggtttggacatcggtagcacgtcaatcgggtggtggatttatgaaacgacggacggccagataacatctgtcattgatggtggtgtgcgtattttctctgatgggcgtgaccccaaatccaaaggatcactcgccgtggatcgacgcgtggcgcgggcacaacggcgcaggcgagatcgatatttgcgacgtaaagcggccctgatgaaacggatggcggaagttgggttgatgccgtcggacccgaagcaagccaaacagttggaagcactcgatccttatgaactacgggcacgagggctcgatgaaacacttgaattgacagaactcgggcgggctttgtttcacctgaaccagaggcgagggttcaaatcgaaccgcaagaccgatgcaggcgacaatgaaagcggcaaaatcatagacgcgacagcgcgtctggattgggccatgcgggaccatagggcgcggacgtatggtgaattcctgcacatgcgtcgccagaaggccgacacacctcgtacgacgcccgccgttcgcacgcgccttacgattgctgcgcgggatggggctgaaaaggaggagtccgggtatgatttctatccggaccggcagcatctgcgcgatgagtttgatgcactttgggaggctcaggcggagtatcatggtgtcctaacagaggacttgagagatgaaataggcaccatcattttccaccaacgtcccctgaaaacaccgaaagtcggcaagtgcttgttcaccaatgaggaacgtgtggcgtccgcccatccgctgaaccaacggcgcattctagttgaaacggtaaatgcgcttcgcgttgcccagctgggcgaagtggcgcgtgctctgacgttggaggagcgcgacacgattttgcacgcgctggacaacaaggcacatacgaaatcgctgtcggggatgagcataaagctcaaggcgcttggaaaggttatcaagctgcggtcagggcaatatttcacactcgagactgccaatcgtgatgctatcgcctgtgatccggtccgcgcaagcctgtcaaaaccggatcgcatcgggtcgtattggtcgaccctggatcataacgctcagtgggaggtcgtaaaccgcatccgcgctgtgcaaagtgacgcggaccatagggaattggtcgcctggttggtgtcgcaacaccgcctggctgccgaacatgccgagggtgcagcctatgcaccgctgcccgatggatatagccgtttggggatcactgcaacaaaacggattcttgcagcgctggaagcaaacgttatcccctacagcaaagcggttgaaagttgtggttggcaccattcggatgagcgcacaggtgaggtgctggaccggttgccctattatggtgaaatccttgatcggcacgtcatccccggcacttacgatgacagtgacgatgatatcacccgctttggacgcatcaccaatcctacggttcatatcgggctgaaccaacttcgccggttagtgaaccggatcatcgaggtgcatggaaagccagacgaaattgtcgtcgaactcgcccgtgatttgaaactgtcacaagaccaaaaggcggacgttgaacgaaccatcaagaaaaacacacaagcggccatccggcgaggtgaaaagcttgaagagatgggcgtgcctaacactggcggcaaccgcatggttctgcgtctttgggaagatttgaacgacgatgatgtgatgaaacggttctgcccctacacggggcaacgtatcagtgcgggcatgttgtttgatggttcttgcgatgtcgaccacatcctgccgttttcacggacactggatgatgggttcaccaacaagacgctttgcctgaaagaagcgaatcgaaagaagcgcaactatgcccctcatgaagccgctgaaaagggcctgcttgatcgtgatgcgatggactcggtggcgaaatatctacctgacaacaaagcttggcgttttgcgcccgacgcgatagagcggttcgagggcgaacgcgatttcaccgcccgcgcgctaaaagatacacagtatctatcgcggctggcacgaacttatctagatgcgctttatgatggtggtgatgataaatcccacgtctgggtggtgccgggacggttgacggaaatgctgcggcggcattggggccttaacgggttggaagctctggctgacagtgatgagaaaaccgtcaaacgcaagaatcggaccgatcatcgccaccatgcgattgatgcggctgtggtcgctgccaccgatcgcagtttgatccagaagattagcaagatagcggccagtgatgaacaggcaggcgcagaggacacgctgaaatccacgccgccgccgtgggacagttttcgcgatgacattgccgcccaattgcaaaacattaccgtcagtcatcgcgcagatcatggacgcacggactcactggcgaagggcagaggcgaagacaccaccagtggggcgctccacgaagcgacagcgctcggtatcattgacgaaacccacgtaaccgtacggattcctatcgaatcactcaagtcaggccatctgatcgagggtagccgcaatggatatatccgcgacccttatctgcgcgaccaactgacacttgccacgaaaaacgggtctgacaaggatttcacgacagtgttgcaaaagttctttgaccggagcaaacggtacggaggcacgcggcgggtgcggattatcaaaacgctccaagataccgcgcggatttcggtgccgcataatgcccctatcaaggcctataagggcggcagcaatcatgcgtttgaaatctggcgtttgcccaacggcaagattgagtcgcaagtcatcacgacgtgggaacatcataatctgactgagcccaagcgcccgcatccagcggccaaaaggatcatccggctgcataagacagacatggttgcgattgaacgagacggtaagacggtcatttgttttgtacaaaagactgacccttccaatggtgcgtttttggtgccccacttcgaggcgaacgcggatggccgaaagcggaaaaacgaaccagtcgagtggtatcaaatgtcagccaactctttgatcaaggccgatttgcgtcgtgtcggcgtcgatgaaatgggccgcgttcgcgaccccggccccccgccgattaggtaa

SEQ ID NO: 13 - DNA, 3135 bp, Mucispirillum schaedleri
atggcggaaaagaaatttaaataccgtttaggtcttgatttaggaacaaactctataggctggtgtatgcttaggttaaataaggataacgaaccagctgcagttattaaatcaggtgttagaatattccatgatggaagaaatgaaaaaacaaaagagcctttggcagttgtccgcagaaatgcccgcagtattagaagaaatcttgatagaaaaatatcccgcagaaatcatctgttaaatacattagtaaaatatttcctattgccatcaaatgaaattgagagaaaagcattagcagttttaaacccttatgaactaagaagcagggcagtaaatgaaagattagaattatttgagcttggaagattattaatgcacctttcaaaacgcagaggatttaaaagcaacaggaaagtagataaagaagacagcagtggtaaaattaagccagctatagaaagattaaaaaataaaatgcaggaaactaataaaaaaacagctggtgagtatttatattctctaatgcagaatggtaaaccagtcagagcccgccttggaagaatagacggaagtaatggatatgagatatatttagacagggctttaatagaagaagaatataatcttataatgaatgaacagaaaaaacatcataaagaattaactgatgatattattaatgagatatttaatataattttttatcagcgaccattaaaaaagcaaataatagggaaatgcagtttaactggtgaagatactaaactgaaaaaagcacatgtattggcacaagattttattttgctgcaaaaagtgcaggatttacgagtatttgatgataatcagttagaatttagaccattaagcaatgatgaaaaagacattattaaaagagaattgcgaaagaaaaaagaagtatcttatgaaaatatacggaaattgttaaagaaatattatgaaaatgttaaatatggtatgttctcacatgaaacattatataaaaaattacaaggtaataaaacaaatgctttaatgtcagataaagagattataggtgacagctggtatagtttatcgccagaagttcagtatgacataatagaagaattatattctgataaagataatgatgaattaagtaaattatattctgaaaaatttaacttaaatgaaagccagataaatggcttattaaataaagccatttatagacttgacagtggatatatcaggtatggaaaaacagcagttacaaacttaaacagcataatggataaagataatttaaatttacacgatgctagagaagaagcaggctatgaaaaggaaaataaacaagatgcatctgaatatctggaatattatggtaaagtgcttccagacagtgtagtagacccacaaattgaaaatcctaaaaatgatgaagaaagatatggtaaaattgcaaacccaacagtgcatgcagctttaaatcaattaagaaagttagttaatgaattaatcaagttatatggcaaaccagagcagatagttatagagcttgccagagatttaaaaaacagtagaaaggcaaaagatgttattaataaaaaaatagcagaaaatagaaaacttaatgaagaagttgataaaacactgcaggagtattcagaaaaatataacacacatattgtaaaaaataaattaaacagagataaagttaaattatggcgggaattagggaaagacccattagaaaggaaatgtatatatactggagagcaaataaatatagcaaaattattcagcgacgaagtgcagattgagcatattgtgccatattctaaaacattagatgatagttttaataataaaactctttcaatgaaacaagcaaattattataaaggcaataaaacaccttatgaagcatttaaagacagtaaagacggatataattatgacgacataattgcaagggcaaagctgcttaataatgacaataaatttaaaagatttacaaaagatgcaatggatatatataatagagatggtaaagattttattgcaaggcagctttcagatactcagtatttatctacacgggcacttatctatttacagtcattatatgaaaaagcacatcacagctctatttggactataccgggtcagttgactgcacttattcgcaactatttaggcttaaacacattaatttctaatgataaaaataaaaacagaaatgaccacaggcaccatgcagtagatgcatttgttgtggcagtaacaagccgttctttactgcagaaaatatcttatgcagcttcattacaggaagatttagataatagaaatgtatcatcatatagaaataaattacttgaaaaaatgccagagccttttccaaattatagaaaaagtctggagcttgctattgataatataaaaacttcccataaagcagatagaagtatatctggtaaattacatgaagatactgcttacgggatagttgaaaatgatgacaaatataatgttgttacaagatggacagtagataaatttaaagagcaaaaacattttgaaaccataagggataatgaattaaaggaaattgcatgtagtgataaagaattatttgctaagatagtagaaacaagaaaaataaaaagcattagaaagctggcaaaagaaaaccctgtaattaaaataaaagataaatcaggcagggactataaagcctttgcaggtggtaataatatttgtgtagagatatatgaagtagatggtgtaagaaaatcagaagttatacagttatttgatgcagcacaaaaaggatttatgccagaatggatgaaaaaatatcctaatggaaaattacttatgcggttatttaaaggcgatgtaataggatttatagagaatagaaaatataattattatacaattaaaggtattagtattgcagaccaaaatcttaaattacttgcaattaataaagctgaaggtatatttaaaaaaggcttaaatatattgtttgatagtaataataaaaactctttaaatgctaaacagtttaatataagtgtaacgggcattgtcactaaaaagaaaacagcagatgttaatttttggaaaaatagaaagtga

SEQ ID NO: 14 - DNA, 3357 bp, Mesorhizobium sp.
atgggcacgcgctattccttcgacatcggcacgaactccataggctgggccgtctggcgcacgggtcgcgaccccaagggcatcttcggcgagaaggatgcgccgctggaactgctcggcgccggcgtgcgcctgttcaaggacggccgcaacccgaaggacgggcagtcgctggcgacgatgcggcgcattccgcggcaggcgcgcaagcgccgcgaccgcttcgtgctgcggcgcgaggcgctggtcgcggcattgatcgaggccggcttgatgcctgccagcgagaaggagcgcaaggcgctggcagacctcgatccctatcagcttcgcgccgccgggctggacaaggcgctggcaccgcatgaactcggtcgcgcaattttccatctgcatcagcgccgcggcttcaagtcgaatcgcaagacagaccgcaaaagcgacgacagggacaagggcaagatcgcgacggcttccgccgcgcttgcaaaaaaattcgaggacgaaaacgcgcgcaccttcggcgaattcctgtggcggcgtcatcgcgaccccgacatgaaacggcaggccgttttgaaagcgcacgacccggccaaagggaagccggatctgcgcgccgcaaagctacgccagccgacccgcatccgcctcgaaggccagggcgcgaccgcgctctacgaattctatccgacacgcgaaatgctgtgccatgagttcgacgcgctctgggaagcccaggcccgccatcatccaatgctgcttacgcgggaagcaggcgacaagatcagatcgatcctgtttcggcagcgcgaactgaagccgccgttaatcggcctttgcactttcgaatacgcggctggcgaaaaggaaagccgactgcccaaggcgctgccttccgtgcaggcgcgcgagatctacgaacggctgggccatatccgcctttccaccggctccggcacggaccgcccgctaaaatcctccgaacgcgacgatttggcgacagcgctgctgcattgcggcctgacgaagatcaaggtcagcaagaccaaagggttggcctttaagactgaattccgcaaggcgctgcgtctcggcggtgaggtcaggatcaatttcgaggaaatgggcgaggaagggttggtcgacttgcgcaccaaccgcctgctcgtccaagacgaccattacggtccgcgctggcgcgcattgtcgtggtcgggcaaggacgccttcgtaaaaaaactgctcgaagcgaccgacgacgacaaactggtcgcccggttaatgaccgaggacggcctgagcgcagtgcaggcgcgcaacgccgcctcgatcccgctgcccgacggctattcgcggctggggccaaccgccaacgccgcgatcctccaggcactgatcgactcgcgcgacgaaaacggcttcgtcgtcacctacgacaaggcggttcgccgcgccggcgagaggctgggcaaggactggcaccattccgatgagcgcgacggcgaaattctcgatgccctgccctattacggcaaggtgctgcagcgccacatcctgcccggcatgatggacccggccgaccgcaaggacgaggcgaaattctacggccgcatcatgaacccgtcggtgcatatcggtctcaaccagttgcgccgactcgtgaacgcgctgatcgaacgcttcggcccgcccgaccagatcgtcgtcgaactggcgcgcgacctgaagatgtcggcgcgcgagaaggagcaggaacagcgccgcaaccgcgacaaccgcgaggcgaacgaaaagcgtactaagaaactggtggaactggggcaggacaacaacggcgagaatcgggcacggctgaaactctacgatgaacagcaacgcgccggcaacggcgtggcgcattgcccgttcacgctcgatccgatcggcatcacgcagcttttcagcccggaaatcgagatcgagcacgtcctgccgcgctcgcgcacgctggacgacagcgccgccaacaaggttctgtgcttccgcaccatcaaccgcatcaagcgcggcaagacgccttgggaagcctttcacgccgatccgaaatggccggacattgccgccaatgccgaaaagctgccgcccaacaagcgctggcgcttccgcgaggacgcgatggacgtcttcgaggcgcgcacctcaggcaagatggacaagaccacgctggagcagatgggcctcaccaccggtttccaggcccgtcacctcaacgagaccaagcacatgtcgcggctggccaaggcctatctcggcaagatctgcgaccccgacgcggtctacgtcacgcccggcgcgctgaccagcttgctgcgcggcaagtgggggctgaattcgatcctctccgacgacaacctcaaagaccgcaccgaccaccggcaccacgcgatagacgccatcaccatcggcgccatgacgcgcagcctgctgctcgagttgaacacgttggccggcaaggccgagcaaagcgactatgacgacgtggtcggcaaggtgccctggcctttcgacaatttccgtgacgccgtgcggtcggtggtggaccgcgtcgtcgtctctaacaagcccgagcacggcaagcagggcgcgctgcatgaagacaccgcctacggcatcgtcggcgacgaggccgaggcggaagagatcggcaatctcgtgcgccgcaagctgctggtagacctgacgcccggcgaggtcgaccgtattcgcgacgcaggacttcgcaaggcgatgcaggccgcggtggcgccgtctcgcgacgccaggggcaaggtttccgacgccaagggctttgccgcagcgctcgataccttcgccaaggcgcaagggatgcgtcgcatccgcgtcggcaaggaggacatgagcgcggtgacgatccacgaccggcaaacagacaaggcctataaggccgtcgcacccggcgaaaaccaccatgtcgatgtcgtgcaaatgcgcgacggcgcatggaaaggctttgccgtcaccgtttttgaagccaaccagaaggacttccggccgcagtgggagcgcgagaaactgggcggcaagctggtgatgcgtctgcacaaaggtgacgcggtggagttggaaagttcaggcgtgcgcctcgtcaaatttgtgcagcaaatctggatgaaatccaacctcgtactgcttaccgagcacaatgagggcggcgacttgcaaaagcgccaccaggacgccgacgatcccttccgctgggacttcgccaacatcggcaaactcaaggagcgcggctgcgtggcggtcaaggtggatgaattgggaagggtgaccaagcgcatttcaaacacataa

SEQ ID NO: 15 - DNA, 3249 bp, Neisseria meningitidis
atggctgccttcaaacctaatccaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgtccgccgcctgacccgccgtcgcgcccatcgcctgcttcgggcccgccgcctattgaaacgcgaaggcgtattacaagccgctgattttgacgaaaacggcttgatcaaatccttaccgaatacaccatggcaacttcgcgcagccgcattagaccgcaaactgacgcctttagagtggtcggcagtcttgttgcatttaatcaaacaccgcggttatttgtcgcaaagaaaaaacgagggcgaaactgccgataaagagcttggcgctttgcttaaaggcgtggccaacaatgcccatgccttacagacaggcgatttccgcacaccggccgaattggctttaaataaatttgagaaagaaagcggccatatccgcaatcagcgcggcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagataaaaaatccccattaaacctttcttccgaattacaagatgaaatcggcacggcattctccctgttcaaaaccgatgaagacattacaggccgtctgaaagaccgtgttcagcccgaaatcttagaagcgctgttgaaacacatcagcttcgataagttcgtccaaatttccttgaaagcattgcgccgaattgtgcctctaatggagcaaggcaaacgttacgatgaagcctgcgccgaaatctacggagaccattacggcaagaaaaatacggaagaaaaaatttatctgccgcccatccctgccgacgagatccgcaaccccgtcgtcttgcgcgccttatctcaagcacgtaaggtcattaacggcgtggtacgccgttacggctccccagctcgtatccatattgaaacggcaagggaagtaggtaaatcgtttaaagaccgcaaagaaatcgaaaaacgccaagaagaaaaccgcaaagaccgggaaaaagccgccgccaaattccgagagtatttccccaattttgtcggcgaacccaaatcaaaagatattctgaaactgcgcctgtacgagcaacaacacggcaaatgcctgtattcgggcaaagaaatcaacttagtccgtctgaacgaaaaaggctatgtcgaaatcgaccatgccctgccgttttcgcgcacatgggacgacagtttcaacaataaagtgctggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaatgcaatctgaacgacacgcgctacgtcaaccgtttcctgtgccaatttgttgccgaccatatattgctgacaggtaaagggaaaagacgtgtctttgcctcaaacggacaaattaccaatctgttgcgcggcttttggggattgcgcaaagtgcgtgcggaaaacgaccgccatcacgccttggacgctgtagtcgttgcctgctcgaccgttgccatgcagcagaaaattacccgttttgtacgctataaagagatgaacgcgtttgacggtaaaaccatagacaaagaaacaggaaaagtgctgcatcaaaaaacacacttcccacaaccttgggaatttttcgcacaagaagtcatgattcgcgtcttcggcaaaccggacggcaaacccgaattcgaagaagccgataccccagaaaaactgcgcacgttgcttgccgaaaaattatcatctcgccccgaagccgtacacgaatacgttacgccactgtttgtttcacgcgcgcccaatcggaagatgagcggtgcacataaagatactttgagatctgctaaacgatttgttaaacataatgaaaaaattagtgttaaacgagtatggttaaccgaaatcaagttggccgaccttgaaaatatggttaattataaaaatggtagagagattgaattatatgaggctcttaaggcgcgtttagaggcatatggaggtaatgctaaacaagcatttgaccctaaggacaatccgttttataaaaagggaggacaactggttaaagctgtgagggtcgaaaaaacccaagagagcggagtcttattaaataaaaaaaatgcttataccattgcagataatggagacatggtacgtgttgatgtgttctgtaaagtagataagaaaggaaaaaatcagtattttattgttcccatctatgcttggcaggttgctgaaaacattcttcccgatattgattgtaagggataccggattgatgatagctatacattctgttttagcttgcataagtatgatctgattgcttttcaaaaagatgaaaaatctaaagtagaattcgcctactatatcaactgtgatagctctaatggacgattctatttagcttggcatgataaaggctctaaagaacagcaattccgtattagcacccaaaatcttgtattgatacaaaaataccaagttaacgaactgggcaaagaaatcagaccatgccgtctgaaaaaacgcccacctgtccgttaa

SEQ ID NO: 16 - DNA, 3264 bp, Geobacillus sp.
gtgagatacaaaatcggccttgatatcggcattacctcggtcggctgggcagtcattaatctggatattcctcgcatcgaagatttaggcgtccgcatctttgacagagcggaaaacccgcaaacgggagaatcactagctctccctcgacgcctcgcccgctcggcccggcgtcggctgcgccgccgcaagcatcgtcttgaacgcattcgccgtctgctcatccgtgaaggagtcttaacgaaagaagaactggacaagctattcgaggagaaacacgaaatcgacgtctggcagctgcgcgttgaagcattggatcgaaaactaaataacgatgaattagtccgtgtcctccttcatctagccaagcggcgcggcttcaaatccaaccgccaaagcgagcgcagcaacaaagaaaacagcacgatgctcaaacatatcgaagaaaaccgggccattctctcaggctatcggaccgtcggcgaaatgattgtgaaagatccaaagtttgcgctccataaacgcaataaaggagaaaattatacaaatacgatcgcccgcgatgacttagaacgcgagattcgactcattttctccaaacagcgcgagtttggaaacatgagttgtacagaagagtttgaaaatgaatatatcgccatttgggcttcgcaacgtcctgtcgcttccaaagatgatatcgagaaaaaggtgggcttttgtacatttgaaccaaaagaaaaacgggcgccaaaagcaacatacacattccagtcattcatcgcttgggagcacatcaataaattgcggctcatctccccatcaggcacacgggggctcaccgatgaggaacgacgccttttgtatgaacaggcattccaaaaaaacaaaatcacctaccatgatatacggacgttgctccatttgcctgatgatacctactttaaaggcattgtgtacgattggggcgaatcgctaaagcaaaacgaaaacatccgattcctcgaactcgacgcctatcatcaaattcggaaagccatcgataaagtgtatggaaaaggaaaatcaagttcgtttcttcccatcgatttcgatacattcggttatgccttgacgttgtttaaagatgatgccgatattcgcagctacttgcgaaacgaatatgaacaaaacgggaaacggatagcaaatttggcgaacaaggtatatgacaacgaactgattgaagaactgttgaacttgtcatttacaaaattcggccatttgtcgctaaaggcgctccgcaacattctcccgtatatggaacaaggtgaggtctactcttctgcttgcgagaaggctggatatacatttacagggccaaagaaaaaacaaaaaacggtgctgcttccgactattccgccgatcgtcaatccggttgtcatgcgcgcattgacacaggcgcgaaaagtggtgaatgccattatcaaaaagtatggttcgccggtatccattcatatcgagctagctcgcgatttatcacaaacgtttgacgaacggcgcaaaacaaaaagagaacaagatgaaaaccggaagagaaacgaaaccgccatccgccagctcatggaatacgggctgacgctaaatccaaccggtcttgacattgtcaaattcaaactgtggagcgaacaaaacgggagatgcgcctactcgcttcaaccgatcgaaatcgagcggctgcttgaaccgggttatgtagaagtggatcacgtaatcccgtacagccgcagtttggacgacagttatacaaataaagtgttggtattgacaaaagaaaaccgcgaaaaaggcaaccgcattcctgccgagtatttaggtgtcggaactgaacgctggcagcagtttgaaacgtttgtgttaacaaacaagcagttttccaaaaagaaacgggatcgactgctccggcttcattacgatgaaaatgaagaaatggaatttaaaagccgaaatttaaatgacactcggtatatttcacgctttttcgccaactttattcgtgaacatctgaagttcgccgaaagtgacgacaagcaaaaagtatatacggtcaacggccgtgttacctcccatttgcgcagccgctgggatttcaacaaaaaccgtgaagaatccgatttgcatcatgcagtagatgccgccatcgtcgcctgcacaacgccaagcgatatcgccaaagtcaccgccttttaccaacggcgcgagcaaaacaaagaactggccaaaaagaccgaaccgcagtttccgcaaccttggccgcacttcgccgatgaactgcgggcgcgtttatcaaaacatccgaaagagagtataaaagctctcaatcttggaaattatgatgatcagaaactcgaatcgttgcagccggtttttgtatcccgcatgccgaagcggagcgtcacaggggcggctcatcaagagacattgcgacgttatattggcatcgatgaacggagcgggaaaatccaaactgttgtcaaaacgaaactgtccgaaatcaagctggatgcaagcggacattttcctatgtacggcaaagaaagtgacccaaggacatacgaagcgatccgccagcggttgcttgagcataacaatgatccgaaaaaagcattccaggaacctctgtacaaaccgaaaaagaacggggaaccagggcctatcattcggacagtgaaaatcatcgacacaaaaaaccaagtcatcccgctcaatgacggcaaaaccgtcgcctacaacagcaacatcgttcgaattgacgtatttgaaaaagatgggaaatactattgtgttcccgtctatacaatggacatcatgaaaggtgttttgccaaacaaagccatcgagccgaacaaaccgtactctgagtggaaggaaatgacggaagactatacgttccgattcagcttgtacccgaatgatctcattcgcattgagcttcctcgggaaaaaacagtgaaaacagccgcaggcgaagagatcaacattaaagatatgtttgtctactacaaaacgattgactcagccaacgggggattagagttgatcagccatgacaacagtttctcgctccgtggcgtcggttcaagaaccctcaaacgattcgagaaatatcaagtagatgtgctcggcaacatctacaaagtgagaggggaaaagagagttgggttggcgtcatctgctcattcgaaaaccggggaaactatccgtccgttacaatcaactcgtgattga

SEQ ID NO: 17 - DNA, 3225 bp, Bacillus okhensis
gtgaccgatacaagagattatagaattggcttagatataggtacgaattcaataggttgggccatcattgagttagaatacaatggtgaacagtatgataagaagggtcttattgatgctggggttcggatgtttgataaggctgaaataccgaaaacgggtgcatcattggccgaacctcgtcgtcttgcccgttcaacacgtagacgtttaaatcgccgtgccgatcgaaagaaatcaattcgccgattgatagtggaacaagacattctaaatgaagcagaattacaagtgctttatcaagaaaaggaacttttagatatttggacaattagggtagaggcacttgatcgaagacttagccgtaccgaatgggctagattgctcatacagttggcgcaacgtcgaggctatagatcagcccgaaaatcggaagaaaatgataaggaaacaggcgttgttttacaaaatatacgagaaaataagaaattgattgacgggtaccgaacagttggagaaatgtgggtgaaggaccctcgttttcaaggccgccgtcataattcacgatctgaatacgtatttaatgtcacaagggaaatgcttgaagaggaaattcgaacattatttcatactcaaagggagttgggtttatcgtttgcttcaaaagagatggaagaatcttatctatcgatttggggaaagcagctaccatttgcaagtgggaaagatattttaaaacgggtgggtttttgtactcttgaggaacaagagcgccgttttccaaaagcgacgtttacttttcaatattttatggtattagataaactgaaccgattaaggatcaaaccaagcatgcgtcctttaacagaagaagaacgtaaaagtacattacattatttatttgatcgagatgacttgtctaaaaagaaaacgccacccaaagtaatgtataaagaaatccgtaaacaattgaatctagcagcaactgaaacgtttaatgagctgacatatgatcctaatgaatcgatgacgaaaaacgagaatgttctctttgtgaacttagacgcctattatcgcattaaacaacaatgtgatttacataatgaaagatatggtccgcgtgactatgatgcgctaggttatgctttgactgtttacaaaacagacaaagatattcgtcaatatttacgtaataaaacgaatctagctaataggatttactcggaggaacttatatctaatcttttatcgcaatcatacgctacttttggacatatctcgaaaaaagcgttattagctattcttccatctatggaaaaaggagatacgtttaaggtagcagctgataaaatgggctatgatacgaccgggttacaactagtaaaaaaagagttattattgccagttattcctaatgatataacaaacccggttgttatgagggcattgactcaagctagaaaagtggtaaatgcaattattaaacgtttgggagaacaaccgctttctattcatattgagttagcgcgagaccttttaaaagggcatgatgaacgccggaaaatctcaaatgaatataaacaaaatcataagcgtaatgcgggggcatataccattcttaatgaaaatgggattatcaacccgcgtggttatgatattgtcagatataaactttggcaggagcagaagcaaaagtgtgcttattcagggaaagtcattccgtcagaaactttttttggtgaacttaaaaaagagagagggcaaggggcacccactttggatgttgaccacattattccttactcgaaatgctttaatgattcttattctaataaagtactagtttatagcgatgaaaatcgtaaaaaaggaaatcatttgccttttgactatttgaaagaaagccctagtcgatgggaagagtttgaaacttatgtactgactaatgaatttccaagagcaaagcgagaacgattgttaaaaaaacaattttcagaggatgaagagagtgtgatgaaagagcgtcatttgaatgacactcgctatgcaagtcgatactttaaacaatttgtagagaagtctttacaatttaagaaatcaaagaatcaatttcataaaaagagggttgaaacagttgctggaagagttacagctcactttcgtcaacgttgggggtttgaaaagcatcgtgaaggcacgcatcttcatcatgcccttgatgccattgtcgtcgcctgcaccgatgcagcaatgatacaggccctttcgttgtatcataaacagaaggaagaagggaaaaaagggtatattaaaaggtttccgctcccttggataacgtttcgcgatgatgttttgaataagctgtcagaatcagccatccctgaacaaatttattctgcgttagtttctggaacaacattgccatcgtatatgcttgtttctcgcatgcctagacgatcagtaacaggtccagtccataaagagaccatttctaaagatggcggggtggatgaaaaagggaaaacgcttattgttaaaaaagtccagcttcaggacatcaaatttaacaaaaatggtgattttttaatgtatatggaagagaccgatccagcaacatataaagctattaaagagcgatatctttcttttaataaagatgctaaaaaggcgtttcaagacccactttacaagccaagtaaaaaggggaagcccaatcaaataaaaagtgtgaaagtcattgttgagaagaaagcacatgtacgaaaagtgaatggtggtgtcgctgaaaatggtgaccttattcgaatcgatttttttcaaaaagagggtaagtttttcatggttcctctttatacttatgatacgattcaatctgacctaccgaatcgttatgttgtaagtgggaaaggttatcaattatggcctcaattaacaaatgaacacaaatttatccaaagtgttcatccatatgaattattaagagttgttaagcgttcgggtgacgatcggtttctatacttagcttctattaatatttcaaataatgtattgaaatttattgagcctaatttccctcataacgattatattgaaatctcattagggacgattaaacatatggagaaatatgatgtgaatgtactaggacaagtttctctaaaagcaacgggaccaagattaggcttcaataatatgaaagctcaaaaaaataaagttaaaggctag

SEQ ID NO: 18 - DNA, 3150 bp, Tistrella mobilis
atgatcaacgaacgcctgacgttcggaatcgatcttggcatcggatcatgtggctgggcggtgcttcgccatgcggatgccgccggagagccgggggtgatcgaggggctgggaagctggtgcttcgatgtgcccgagacgagcaaggagcgtatcccgaccaatcaggtccggcgcagcaatcgcctgctccgccgggtcatccggcggcggcgcaatcgcatggcagagatcaggcgtctgtttcatgcccagggcctgctgccttcggcggatgaggacgccctgaagcgtccgcgtctcgacccctgggaattgcgggcccgagggctcgatcaatgcctgagtgccgaagaattcgcggtggcgctcggtcatatcgccaggcatcgtggcttccgctcctccgccaagcgcaaggccgcgaataccagtggggaagatagcaagatgctgtcggcccttctggtgacgagggagcgtactgcccgctatcgcaccgtcggcgagatgttcgcccgcgatccggaatacagtgcacggcgccggaaccgtgacggcattttcgaccggaccgtcgcgcgggacgatctgatccacgaggtcggcaagctgttcgaagcgcagagggcgcgcggcagcgctttcgcctcgcccgatctggaggcggatttcaacgcgatcgcctttcgtcaggcggagatgcaggacagtgaacgtcttgtggggaattgcccgttcgagcgggatgaaaagcgcgccgccagatgggcgccctcgttcgaacgtttccgtctgctgacccggctgatcaatttgcggatcgcgacggccgaaggggagcgcaggttcaccccggaagatctggcccgcgtctcggccgaactcggcgcgacggcaaaactcccggtcagccgcgtgcgcgccttgatcgggcttctgcctgacgagcgtttcaccacgattcgggttgaggacgaggatcgcgatatcgttgcccgaaccggcgaagccgcacccggtacctggcggctgcgcaagaccctgggcgaggcgctgtgggcggagatgcaggcccgacccgatcagctggacgccattgcgcatgtcctgagtttcttcgaagccacggcgaagatccggtcggaactcgaccggctgggactgcccgcggccgtgatcgaggccctggaccgggggctcgaagacggggcgttcgcgaagttcaagggggccggacacatctccgccaaggcctgccgcaatctgctgccccatctgcaacagggccatcgctacgatcaggcctgtcggcttgcaggctatgaccatgctgcatcgaccctgtcgcacacggctcaggtggtgagcaaggccgggttcaacgcgctggtgacggagctgggcgagagcatcgccaatcccatcgcccgcaaggcgctgaccgaggggctgaagcagatccgcgcgatgtgtgcccgctggggcctgcccggcgccatccatatagaactggcgcgagaggtcggcaacagtatcgaaaagcgccgagaactggagagccaacgggagacgacgaccaagcgccgccagaccgagcgggatgaaatccgcgggctgctggctctggaggacgtcgacgacgacaccctgctccgctaccgtttgtggaaggaacagggcggcaaatgcctgtacaccggcaaggacattcatgtccggcagttgatcgccaccgacaacagcgtgcaggtggaccacatcctgccctggtcccggttcggcgatgacagcttcaacaacaagaccttgtgccttgcgagcgcgaatcagcgcaagcgcgggcagacaccctgggaatggttcagcctgaccgggacgcccgaggcctgggaggtcttcgcgagccgggttgaaacctcgaaggatctgcgtggcttcaagaagcgcaacctgcttctgaagaatgccgacgaggtcgctcagcgcttccgcagccgcaatctgaacgacacccgctatgcggcgcggctgctggcggaggctgcgaagctgttctatccggccggtgaccggcaggagaaagacgggcgccgccgggttctgacccgccccggaccgctgaccgcggcgctgcgccatgcctgggggctggagagcctgaagaaggccgacggcaagcgggtgagcgacgaccgccaccatgccctggatgcacttgccgtggcggcgatcagtgaaagggaggttcagcgcctcacccggtctttccaggagtgggagcagcaggggctcgcccgcccgctgcgccatgtggcgccaccctggcccggcttccgcggcgacgttctggcggcctatgcgcaggcattcgtcgcccgccctgagcgtcgtcgggcgcggggcaaggggcatgatgcgagtatccgtcaggttgtcggagagggcccggaggcgcaggtgttcgagcgccggggtctggcggatctcaaggaagcggatctcgaccgggtcaaggatcctgagcgcaatcaggcgatcatcgaggccgtgcgcgcctggatcctcgccggccggccggccgatgcaccgccgcggtcaccgcgcggcgacgtcatcgtcaagctgcggacggcgccggccaaaaagatcaagccggcggtgccggtgcggggcggaaccgccgaccgcggcgacatggtgcgtatcgacgtcttcactaggccgaaccgcaagggccgggacgaatggtatctggtgccgatctatccccatcaggtgatgaaccggaaggcctggccgcatccgccgatgcggtctgttgtggcctacaaggacgaggccggctggaccgagatcggggcggagcactcgttccgcttcagtctgtatccgcgcagctacgtccagctggtgaagtcgaatggtgacgtcatagaaggatatcttgtctcaatggatcggtcgacaggcgctttccgcgtctttgttcataataatcccgcggaaatggcgaaaggaatcggagcgaaaacattgttgaatctcaggaaatttaatgtggatcgctttggggtgcgtactgaagtgaaaagtgaggtcagaacatggcatggagaggtgtgcacatctcccgtcccgcccgattga

SEQ ID NO: 19 - DNA, 3183 bp, Kingella kingae
atggctgcaaaatcattaaattacattttgggtttggatttggggattgcgtcttgcggttgggcggttgtggaaatggacgaacaagaaaatccacttcgtttgattgatgtgggcgtgcggacgtttgaagaagccgaaaaccccaaagacggttcatcgttggcggaaacgcgccgattggctcgcgctcaacgccgtttaatcagtcgccgcgctaatcgcatgaacaaattgtgccgtttattgaaacaagaaaatgttttgcaagccaatgattatgatgaaaaaggtttaatcatcggtttacccaatcaggcgtgggaacttcgcgcacaaggtttggacagaaaacttgaacccaaagaatgggcagcggtgttgattcatttggttaaacatcgcggctatttgtcgcagcgcaaaaacgaaagccaaacggcggataaagaattgggcgcgttgctgtcgggcatgaatcacaatcatcaattattacaatctcaatctaatcaatatcgtacgccagcagaattggcgattaaacaatttgccacgcaagacggacacattcgcaatcaacgtggcgcgtacacgcacacatttaatcgtttggatttgcaaaatgagttaaatcaattatttgacgcgcaaacacgtttgggcaatccgcacgtttcaggcagcctgaaaaccgcgattaatgatttattgatgaaccaaaaagctgctttatcgggcgatgcgattctggaaatgttggggcgttgcacgtttgaaccgagcgaatacaaagccgcaaaaaatacatacagcgcagagcgttttgtgtggctggggaaattgacgaatttgcgtattcaagacaatggcttggaatctgctttatcgcgtgaacagcgtgaattgttattgaacgagccatacaacaaaacaaaattgacctatcaacaagttcgtaaattgttaaggctgcctgaaaccgcatttttcaaaggtttgcgttatggaaaagacaatgccgaatctgccactttcatggaaatgaaatcgtatcacgccattagaaaatctttggaaaacaaatcgttgaaatcagaatgggaaaagctgaaaacgcagcctaaactattagatttaatcggtacggcattttccatttacaaaaccgatgatgagattgcaggctgcctgaaaaatcaattacccgaaaatgtgataattgccttgcaagggcagttaaatttcagcaattttatggaattgtcgttaaaagcgttggaaaaattgttgccgttaatggaacaaggtttgcgctacgatgaagcgtgtacgcaaatttacggtaatcgtcacgaaaaaattgccgataaaaccgaaaaattcttgccgaatattcctgccgataaactgcgaaatcctgttgtattgcggacgctcacgcaagcgcgaaaagtgattaacgcgattattcgccgatacggttcgccagcgcgtgtacatattgagacaggacgagaagtcggtaaatcattctctgaccgcgataaattaaaaaaacaacaagaagaaaatcaagaacaacgccgacgcgctattgatgaatggaaacagtttttccccaatgcagcgcatgaacccaaagcggtggatattttgaaattgcgcttatatcaattacagcagggcaaatgtttgtattcaggtttgccaattgatgttcgcaggctgcctgaaaaagggtatgtggaaattgaccacgcgctgccattttcgcggacttgggacgacagtttcaataataaaatcttagtgttggcttcggaaaaccaaaacaaaggcaatcaaacgccatacgaatatttacgtggtgcggacaacagcgagagttggcggttatttgtggaaaatgtgcaaaattgccagttttcgcccaataaaaagcaaaaaatcatggcaaaacagcttgatgaaaaaggttttcttgaacgcaatttgaacgacacgcgctatgtttcgcgctttttgtgtcaatttatcagcgagcatttgcatttaacaggcaaaggcaaaaagcgcgtgtttgccagcaatgggcaaattaccgcgttgttgcgtgggcgttggggtttgagcaaaaatcgtgaagaaaatgaccgtcatcatgcggtagatgcggtggtggtggcgtgtagcacggttgccatgcagcaaaaaatcacgcaatttgtacgttatcaaaaaggcaatgtgttcacaggcgaacgcattgacaaggaaacaggcgaagtgatttcaatccattttccaacgccttgggaacatttccgtgaagaagtgatgattcgtgtatttgatgataatccgctccgaacgctgcctgaaaaattaccaaaccgccccgaagccttgcatgaatacgttatgccgttgtttgtgtcgcgtatgccaacgcgaaaaatgactgggcaaggacacaaagaaaccattaaatctgccaagcgtttagacgagaaaatcagcgttttgcgcgtgccattaacgcagttgaaattgaatgatttggaaaacatggttaatcgtgaacgtgaacctgctttatacgaagccttgaaagcgcgtttggaacaatttaaaaatgaccctgcaaaagcctttgctgaaccattcttcaaacaaggcggacagcaagtcaaagccgtgcgcgtggaaatcgtacaaaaatcaggtatgttgttacgcaaaatcaatggtgtggcggataacggttctatggtgcgcgttgatgtgtttgagaaatcaggaaaattttatcttgtgccaatttatgcgtggcaagtggcagaaggcattttgcctaattatgccgtagtggcacataaagatgaaagcgattggattttaatggacgaaagctatcattttaaatttgctttgtataaaaatgatttgctagaagtgcaaacaaagaaagggggcattatgggttattttgcaagtttagaccgtgcaacaggtgcaattaccattcgtgaacatgaccgtgataagaaaaaatgtaaagatggcgaacatcgaagcattggtgtgaaaatggcttcatcattcaaaaaactgcaagttgatgaattaggtaaaaacattcacgaaacacgtagcagaaaacgcccaaatattggctaa

SEQ ID NO: 20 - DNA, 3200 bp, Clostridium perfringens
gtgaataaagatattaattatgctttaggattagatataggaataacatctgtaggttgggcagttataaacttagatctaaatagaatagaagatttaggagtaaggattttcaatgcagcagaaaatctaaaggatggatcttccttagcattaccaagaagacttgcaagaggtagaagaagattgcttagaagaaaagcctatagagttgaaagggttagaaaacttatattaaagaataatatattaactaaagaagaacttgaaggtttatttaaaaataaagaggtaattgatgtctgggaagcaagggttaagggattagactataaattatcaagagaagaatgggcaaaaattttaataaatttttgtaagagaagaggatttaaatctaatagaaaaaatgaggcaaaagataaggaagcaggacaaatattaagtagcattagctataacatagaaaagatgaaggaaacaaattcaagaactataggagagtatatttataatgaagttaaaaattcagaggatagttatgctcctttaaggaataaatttggtgaatataagatgtgtgtttctagagatgttattagagaagaaatacatactttgtttgaaaaacaaagagaattaggcaataactttgctagtgatgaaatagaggataagtattttgaaatatttaattctcaaagacctttttctaattttgaagatttagaaaagcttgttggattttgtacttttgaaagaaagaaacataaaagagcaccaaaacattgtatttcttctgaagaatttactttatatgaaggaatcaataaactatcaataataaaagatggagagaaaagaaagctttcagaagaggagagaaccttagttgttaatgaggcttttaataaaaaagagataaaatatacaactttaagaaaattactaggattaagtgaagaggaacttttctcaacattgacttatagcattgataaagatatatcaaaaacagagaatacaaaatttgtttctctaaaaggatatcatgaaataaaaagagctatagaaaaaggagtttctaaaaaagcttggcaggatattgaaaataatagaaaccttttaaatgacatagcctatgtattgaccttaggaaaaacagatgatgaaattgagaagcagttaagacttagaaatgttccagaggaattatttgaatctttattagatatgtctttcaataagtttaataatttatctatatatgctttagaaaaaatattaccttttatgaaggaaggatatcaatataatgaagcttgtgaaaaagctggatataattttaaagctatttatgaaggagtaagaactaaaaagttacctgttatagaaatagatgaaatagtaaatccagttgtaaatagagctttagctcaaactagaaaggttattaactctgttatagataaatatggttcaccagttaggataaatatagaattggcaagagatttagctaagaattttaaagatagaaagttaatagaaaaagagcaaaaagaaaatagagctaatttagataagataagagaaaatcttagagaattaatggataaagagcctacagttgtggaagttttaaagtatcgtttatgggagcaacaaagaggagaatgtgcatacactcaaagtcaaattcctttagaaagattatttagtccaggatactgtgaaatagatcatattattccttttagcagatcttttgatgatagtctttcaaataaaattttagtattaggaagtgaaaatcaaagaaagggcaatagaaccccttatgaatattttggagaggattctgaaaggtggaatagttttgaaatatgggttaagggaagctatttaaattataagaagaaagccaatttacttaaaaagaaattttcagaagaggaacaaagggattggaaagcaagaaatttacaagatacaaagtatatatgtagatatatttcaaactttgttaataatagattagaatttaaagaaagtgaaaataagcaaaaggttataactgtaaatggaagagctacagcttatttaagaagtagatggggattaaataaggtaagagaagatggagataaacaccatgctttagatgcagctgttgtaggggttacaactcaagggatggttcaaaaaatatcaaaatatagtaaagcacatgaattatatacagttagaaagaatgacgagtttgtggatgttgaaaccggtgaatgtgtagatgttgatgagtataaagaaataagaaaagatatacttccaagaccatggcgtgggtttagtgaagaattgaaattaagacttagtgataatccattagaagagttgaaaaaatcacctatagagacttataatgaagaatttataaaagaaaatgttaaacctatttttgtttcaagggttccatttagaaaaataagtggaaaactatttaaggaaactatttattcggaaagagcttttaaagatggatattttgtctctaaaaaaagtttagttgatttgaaaaggggggatttagataacttttataattatgagtgcgataagaaactgtatgatgcaataagtgagagaatgaaagagtttaattataatggaaagaaagcttttgagagtccatttagaaaacctactaaaagtggaaaagaagggccagttgttagaagtgtgaaaattaaatcagcagtaccttttaaagatggaattcctatgaatgaaggattagttgctaaggaaggtatggttagaatagatatttatgagaaagaaggaaaatattttgttgttccagtttacagatatcaattagcaaaaggcatagttcctaaaagagcagctatagcaaaaaaagatgaattaaaatggcctattatggatcaaacttataatttcaaattttctatatataagaatgatttaattgaggttaaatatgataaaaagggagtatattttggatattatgatggatttgatagaaatagtgcatcattaacaatagaaaaacatgataattcagaaagatatagaagtatagggctaaaggtaggggtacttgaaattaataaatatgaagtagatgttttaggtaactatcataaagttaagttaggagggaactagat

SEQ ID NO: 21 - DNA, 3210 bp, Neisseria sp.
atgaaaaaacagccgcaacgctatattttgggtttggatttgggtattgcttcagtaggctgggccttgatcttagtggatggagcggaaaatcccgtcggcctgctggattgcggggtacgcacgtttgaacgggcggaagtgccgaaaacaggcgattctttagccttggcccgcaggcaggcgcgcagtgtgcgccgcttaatccgccgccgcgcccaccgtttactgcggttgcgccgcctgctcaagcgcgaaggtattttgagtgctgccgactttaattcagacggactgcctaatctgccgattgatgcttggcagttgcgtgtggcgggcttggagcgaaaactgacaaatcaagagtgggcggcggtattgctgcatttggtcaaacaccgcggttatctgtcgcaacgaaaaagcgaaacccaaacggaaaacaaagaattaggacgtctccttgccggcgtggccgaaaacagcaaactgctgtcagaaagctccgaacaataccgcacgcctgccgaattggcggttaaattatttgcggaacaatcggggcgtttgcgcaataaaggcggtgattacacccacactttcaaccgcttggatttacagaaagagctgcatttgctgttcgagcggcaatgtgcgctcggaaacccgtttgcttcggcagagttgcaaagcaaagttgacgaattactgatgacgcaacgcagtgccttacagggtgaagcagtgttgaaaatgctcggtaaatgcacatttgagccttccgaatacaaagcggctaaaaatacttattctgccgagcggtttatttggctgaccaaactaaacaacctgcggattctgtacaacggcgaagatcgggctttggatgaaggagagcgcaaacaactgttggacgagccgtataaaaaagccaaactaacgtataaacaggtgcgttcaatattgaatctgcctgaaagcgcagtattcaaagggctgcgttacggaaaagattcagacggcctcaaggcggaaaacggcgcattgatggaaatgaaggcctaccacaaaatccgcacagtactggaaaaagcaggtttgaaaggcgaatgggaaaaccgcatccgcaaccccgaaatactggatcagattggtacggcattttcagtatataaaaccgatgaagacattaaagcagagttggccgctttaaggctgcctgaaaacgtgttggatgcgctgctggccggtttgaacttcgataagttcatccaactttcactgaaagccttaagcaatattctgcctttaatggaacgcggcatacgctatgacgaagcctgcaaagaagtttacggcgatcaccgtgccttggcagaatcaaaaaaccaaatgctgctgccacaaattcctgccaacgaaatccgcaatcccgtggtactgcgcacactcacacaagcacgcaaagtgattaacgcgattatccgccgctacggttcgccacaacgggtgcatatcgaaacggcgcgcgagttgggcaaatcgtttaaagaccgaaaggaaatcgaaaaacgtcaggaagaaaaccgcaaagaacgcgaacgtgcggcggaacattttaaagaattgttcccgcgttttaccggagaacctaaaagcggcgatattctgaaactgcgcctgtaccaacagcaacagggcaaatgcctgtattcgggcataccgatagatttaggccgtctgaatgaaaaaggctatgtggaaatcgaccacgccctgccgttttcccgcacgtgggacgacagctttaacaacaaagtgctggtgttgggcagcgaaaaccagaaaaagcgcaaccaaacgccttatgaatatcttgatggtgctcgcgacagccaacgctggcgcgaatttcaggcgagagtacaaggctgtcgttttccttatgctaaaaaacagcgtattcagacggccaaattggacagcaaaaccgaacaaggctttttggaacgcaatctgaacgatacccgttatattgcccgctttttatgcggctttattgaaaaaagcctgcatctgcaaggcgcgggcaaacgacgcgtattcgcctcaaacggccaaatcactgccttgttgcgcggtctgtggggcttgaaaaaagttagggaagacaacgaccgccaccacgcactcgatgctatcgtagtcgcctgctccaccgtttccatgcagcagaaaattaccaaagccatgcagcggcgtgaaaccttggaaacaataaataccgaaaccggcgaagtcaaaacccgcattccgcagccgtgggatttcttccgccaagaagtgatgatacgggtgttcagcgacgccccgcgcgaagagttggcagagaaattaaacagccggcctgaagcgctgcatgattttgtatcgcctttatttgtctcacgcgcccccaaccgcaagatgacagggcaagggcatcttgaaaccgtcaaatccgccaaacgcctgtctgaaaacatcagcgtggtgaaaaaaccgctgacagcgttaaaactgaaggatattgaaaacattgtcggctatcccgaccgcgagcctgctttatatcgagctttgcaggagcgattgcaggcatataaagatgatcctgccaaagcgtttgccgagccgttttacaagcctgcgaaagatggcggacaagggtcattggtcaaagcagtgcggattattgaaaataccaaacatggcttaaaagtacgtaacggcattaccgatactaacggtgatatggttcgggcggatgtctatcaaaaagccgataaaaaagggaaaaggcaatatttcattgttcccgtctatgcttggcaagttgaaaaaaatgagctgccgacagttgattgtaaaggatatgaaattgatgacacttatgaattttgttttagtttatataaatatgacattattgaaattcaaaaccctgataacatgagcaaagaactccgagtttactatatcaattgtgacagctcggatggtagattttggctggcacatcatgataaaagcgctaaagaacagcagttccggatcagtacgcaaaatcagccgatcataaaaaaataccaagtcgacccattgggcaaagaaatccgcttgtgcaaagcagaaaaacgcactgaattgaatggcaaaaagaaaaaataa

SEQ ID NO: 22 - DNA, 3006 bp, Campylobacter coli
atgaaaattttaggttttgatatagggattaactctataggttgggcttttgttgaagataatcaattacaagattgtggcgtgagattgtttaccaaggctgaagaccctaaaacaagagaatctttagctttacctagacgcaatgcaagaagcaatagaagacgactaggaagaagaagatcaagactgattgctttaaagcatattatttcaaaagaattaaaattaaattatcaagattatatagcaaacaatggagaattgcctaaagcttatgaaggaagacttataagtccttatgagctaagatataaagcgcttaatgaaaaaatagaacccaaagatttagcaagagtgattttacacatagcaaaacatcgtggttatatgaataaaaatgaaaaaaaatcaagcgataatgaaaagggtaaaattttaagtgctttaaaaacaaatgctttaaaattggaaaaatatcaaagtgtaggagagtatttttataaagaatttttccaaaaatatagagaaaatacaaaagattttataaatatacgcaataaagaaggcagttatgaaaattgcgttctagcaagtgatttagaaaaagaattaaaactgattttagaaaaacaaaaagaatggggatattcttataatgataattttataaaggagattctaaaagttgcattttttcaaagacctttgaaagatttttcatatttggtaggagcttgcaccttttttgaagatgaaaaaagagcttgcaaaaattcatatagtgcttgggaattcgtagcattaaccaagattatcaatgagctaaaaagcttagagaaagagagtggagagcttgtatcgagtcagattatcaatgaaattttaaatcatgtcttagataaaggaagtatcacttataaaaaatttagagaatacattaaacttcatgaaagtatgaaatttaaaagtctaaagtatgataaggacaatgtagaaagtacaaaactgattgaatttagaaaattagtcgaatttaaaaaagccctaggagagcattccttaagtagggaagaattagatcaaatagcgacttatatcactctaattaaagataatgagaaattaaaaattactttagaaaagtatagtttaaataacgagcaaatcaagaatctgctagaaattgatttcaacgatcatataaatcttagttttaaagcacttaatctaatcttgcctttgatgaaagagggaaaaagatacgatgaagcttgcaagcttttaaatttaaaaacaaaatcaaacaatcaaaaattcgatttcttacctgccttttgcgatagtatttttgcacaagagctcaccaatcctatcgtaaatcgtgctataagcgagtatagaaaagttttaaatgctttgcttaaaaaatatggaaaaatgcataaaattcatatagaattagcaagagatatagggctgagtaaaaagcttagggctaagatcgaaaaagaacaaaaagaaaactatgagaataatatttgggctttaaatgagtgtgaaaattttggacttaaggcaaatgctaaaaacatcttaaaattaaaactttggaaagaacaaaaagaattttgtatttatagcggtaaaaaaatatccatagaacacttaagagatgaaaaagctttagaggttgatcatatatatccttattcgcgaagttttgatgattcttttttaaataaggttttggtttttaccaaagaaaatcaagaaaaactcaataaaacaccttttgaagcctttggagcaaatgaagaaagatggagtaaaattcaagctttagctcaaaatcttccctataaaaagaaaaataaaattttagacgaagcttttaaaggcaagcaacagcaagattttatcagtaggaatttaaatgatacaagatatatttcaactcttattgttaaatacacaaaagaatatttagattttttacctttagatgaaaaagaagatataaatctaaaaagtggagaaaaaggaagtaaaatacatgtgcaaacaatcaatggaatgcttacatcagttttaaggcatacttggggatttgctcaaaaagatagaaacaaccatcttcatcacgcgcttgatgccacgatagttgcttatagcacaaatgccattataaaagctttttcggattttaaaaaagaacaagagcttttaaaagcaaaactttatgctaaagaacttacaaatgatagttataaacatcaagctaagttctttgagccttttgaggggtttagagagcaaattttaaatcaaataaacaaactttttgtttcaaaacctcctagaaaaagagcaagaggagctttgcataaggaaacattttaccctaaagatgaaatgattaaaaaatacaactcacaagaaggtgtagaaatagcactaaattgtggaaaaataagaaaaataggtacaaaatatgtagaaaatgacaccatggtaaggattgatatttttaaaaaacaaaataaattttatgctatacctatttatactatggattttgctttaggagttttaccaaataaaatagtaattgcaggtaaagataaaaagggcaatccaaagcaatggcaagaaatagatgaaagctatgagttttgtttttctttgcataaagatgatttggttttgatacaaaaaaaagatatgcaagaacccgaatttgcttattataatagttttgatatcggtaactcaagtatttgtgttgaaaaacatgataataaatttgaaaacttaacagacaatcaaaagctattgtttgtaaatgcaaaagaaggaagtgtaaaggctgaaaaattaggaattcagggattgaaaatttttgaaaaatacattataaccccgcttggagaaaaaattaaggctgattttaaaccaagggaagatattgccttaaagacgagcaaaaaacatggcatacgatga

SEQ ID NO: 23 - DNA, 3147 bp, Sulfurospirillum sp.
atggttgagaaaattttaggaatcgatttagggattagctcacttggttgggcagtggttgagtacgacaaagataacgatgaaaacaacaaaattattgattgcggtgtaagattatttactgctgctgaaactcccaaagaaaaagaaagccccaataaagctaggcgagacgcaagagggcttcgccgtgtgattaaacgacggcgtgttcgaatgaatactatcaaaaatcttcttataacgtataaactcattgataaaacgctcttagatgaagaaatgggcatgtttcactcccaaagtaaccgtgtcgatgtttggaaactccgccatgatgcactctatcatcttttaagtggcgacgaactggctcgtgtgctgattcacatcgcaaagcatcggggatataaatttttaggcgatgatgaaagcgacgaagagagcggaaaagtcaaaaaagcaggtgctgaactcaagaaaaaatttcttgaagcaggatgccaaagtgtgggtgaatggctttggaaagaaagaggcttgcaaggtaaaaagcgcaataaaagcggtgattacgagatttcaattcctagagactttttggttgaagagattcaacgcatttttgaaacacaacaaaaatttggctctacttttgccacttctgaacttcaaaaagcctataccgacatcgctttttatgtcaaaccgatgcaaagtatcgaagatatggttggttactgcactttttatccaaaaatcaaaagcaaaaatcaagatggagaaaaaagagcacctaaagcttctccatcagccgaacagtttgtaatactaagtaaaattttttcaaccattgttattgatgaaaataaacaagaaaaaaagctaattgaattaaaaagtattgaacaacttattcaaatagctagaagtaaagaaacactcaaatataagcaactgcgaaaagagttaaatcttgcaaaagatatatcgttcaaaagtataagcgatgaggaaaaaacatggataaatcttgtagggaatgcaaaatttaaaaaaattcttggtttgaactatgaaacttttttaaaaaatacagaaatttcagacgagatagcaaaaattttaacctacgataaaacatttgaacaaaaagaaacaaagcttaaaaacttacttgtcaatattgactggatagataacaatcatattgccgaattggctaaattatcttttagtcaattcaaccagctttcacttaaagcaataaaaattatttctaaaatcatgatagaaggctatgcaaggtatgatgaagcagttcaatatgcattcgaaaataacttattgccaaaaccttctcatgaaaaatccatccttttaccacctctcaaagagacaaacatcgccatcttaaacccaaccgtcatccgagcatttgcacaatttcgccaagttgccaatgctttagtctcaaaatatggcagtttcgataaagtgcattttgaacttgcgagagaagtcaatacaaaagaagatagaaagcgctgggaaaaagacagagacaaaaacgaaaaaatgcatcgtcaaattactgaaaaactcgtagaagaaggtgtgaagccaagctacaaaaatatcttaaaatctaaattacgaagtgaacaaaaagacacttgtccttactgtcaaaaaaatttacattaccccatgatttttgaagatggctatgctgaaatagaccatatactccctcttagtcaaagccaagacgacagctatgtcaataaagttcttgttcacagtgcatgcaatcaaaacaaaaagaaccgaacaccgtttgagtggtttcaagatgaaaaaaaagattgggatacctttaaaagctatatcttaatggaatctactttaggggagaaaaaaagaaattacctcataaaagaaaattttagtgacccacaaagtcgaaaagagtttatttcacgcaacctcaacgatactcgttatatgtcaaaagccattaagacttattgcgaaaatcactggaaactctcacacgatgatgacaagcttcgtattcaagtgcgtagtggaaagctaacctcaacacttcgtcatcaatggggattagataataaaaatcgtgaaacgcatacgcatcatgcgatggatgccatcatgatagcgtttagtacgcaaggtatggttaaaaaactcagcgattattttgccaaaaaagaagcaaaagtcgaaaaagataaacccgttctaataactccaataaaacagtttaaagaagctgttgagcaagcaacaacgcttgaacgccaagagagtatccaaacaaaagcgggagataccattacactcaaccgccttcttatcagccgaccacctcgtgctagcgtaacgggagctgcacatgaacaaaccgctaaaccttatccaagaatcaagccaataaaaaataaatacaaaagaaggcggattcctatagacgaagataaatttgagctttttagaaatgataaagtcgctagcggaaatgataaaaatttttacaactcaagcacaattccaagagttgatatatacaagaaagatgataagtatcatgtagttcctatctatctttcagatatgacaaaagcagaagtccccaataaatctttaggtacaaatcctgagggaatggatgaaaaatatttttgctttagtgtattcaaaaatgacctcattgaattagagacaaaagcaacacctaaaaaacctagtaaaaaactcttagggtatttcaaacagcttaatggtgcaaattttatattaaactccatacataatggcataatagatggatttgtatgctctcccataacactttttaaacaacaaaaagacatgtgtaaaaaatgtttaccagaagatagagctatcggtaattgctcgcaagaaactttagagttttgggaagctgaaaatattaaagtacccaaaaaagatttcgagtgcgatcaaggcattaaatttgctattgcggtacgaaaatacaccatcgacccactcggttattaccacgaggtcaaaggagaaaaactcttaggcaccataccacaaggagccaaaaaacacccaaaacgccaaaaataa

SEQ ID NO: 24 - DNA, 3348 bp, Dechloromonas denitrificans
atgagtgcgacatataccatcggattggacattggcatcgcctcggttggctggtgcgccttcggagaaacccacatcctcgacttgggggtgcgggcatttgataaagccgaaaccgccaaggaaggcgaatccctgaatcttgcccgacggaatgcgcgcctgatgcggcgacgtttgttccggcggacgtggcgactgaagaaactagctcgccagctgaaaagcgagggcctcatcgccgacaccaaactgttcaagcctgagctgcctttctcaaaatctctctggcaactacgggtcgatggcctcgaccgccgacttaacgacgaagaatgggcacgcgtcatttaccacctgtgcaagcaccggggttttcactggatcagccgcgccgaagcgaagcaggccgaaggcgacagcaagagcgaagggggtaaggtcaaacaggggctggccggtacggccaagctgatggatgaaaaaggctatcgcagtgcggctgaaatggttctggccgaattcccgcaggcgcagcgcaacaagcaaggcgaataccaaaaagcactttcgcgggaactgctcgccaaggaactggcgttacttttcgcccagcaaagggaatacggcaacctgcatacccccggcgcactggaaacggccatcctcggcaacggcgacaaaaagagcggattgttctggcagcaaaaaccggccctggctggcaccgacctgctcaagatgctcggtacctgcaccttcgagaaaggcgaataccgcgcccccaaagccagcttcaccgccgaacgccatgtctggctgacgcgcctgaacaatctgcgcatcgtcaccgacggcgttacccgccagctcaccgagcaggagcgccaactctgcctgcccttgccctatcggcaggccggcgacttgacctataaacagcttggtagcgcgctcgccaaagccgggctgctggaagccggcggtttcaaattcaccggcctcgcctacccgaccgaggcacaaaaggctgaaggcaaggccaaagacccggaatcggccacattggtcaaaatcccggcctggcatgaactacgacaaacgctcaccaagggcggcctcaacgacgagtgggaaaaactcgcaggggatgccctctgcggtcaaccagagattttcgacaaaatcgcctgggtgttgagcgtatacaaggacgacgacgaagtccgcgccgaactcgccaagctggccctgcccaatccccaggcgctgaccgaagccctgctcaacatccgtttcgacaaattccactccctgtcgctgaaagccttgcgcgccatcgtgccgcacatggagcaaggcctgcgctacgacgaggcctgcgttcaggccggctatcaccacagccagttgctcaaggtcggcgaaggcgaacacaaatatctgccaccgttgtacgacggccgagacggcgatggtcggatgatcttcgccgaggatgccgacattccgcgcaaccccgtcgttctgcgctcgctgaatcaggcacgcaaggtggtcaacgccatcatccggcgctatggctcgccgtcggcggttcatatcgaaatggcccgcgacctgtcccggccattcgatgagcgcaacaagatcaagaaggatcaggacgaataccaggccaggaatcagcgtgacagggaacaattcagcgagctattcggccacccgccgaaaggtcttgagttcgaaaaatggcgcctgtaccgggaacagaacggccaatgcgcctacagccaaaggccgctcaccgcgtcgggcaatgtcgccgaaatcttcctcgatggctcgacggaaatcgaccacgccctgccctactcacgcagtttcgacgacagcaagaacaacaaggttctggtgctgacccgcgaaaaccgcgacaagggcaaccgtaccccctacgagtatttgggcggagccgagaacagcgaaagctggcaacgcttcgtttcgttcgttgaatcgaacaaggcctatcgactggccaagcgcacccggctgctacgcaaggatttcggtgccaaggaatccgaggagtttcgcgaacgcaacctgaacgacacccgctatgtttgccgcttcttcaagaactacgtcgaacagcacctgaaacttgcagagggcagcgagaccaaacgctgtgtcgtcgttagcggccaactgaccaatttcctgcgcgcccgctggggactgctcaaggttcgttccgacagcgaccgccaccacgccctcgatgccgccgttgtcgccgcatgcagccacagcatggttcagcgcctttccaattactcgcgtacccgcgaactagagcaggtgcgcgatggcttcgtcgatatcgaaaccggcgagatcgtcaatccggccatgcaccagcaactgcgcgaacacttccccgacccgtggccctacttccggcacgaactcgaagcccgcctgaagatcgactcgccggaattgttgcgggaggaaatggcgcgtttgggtagctacagcgaagaggaactcaaggtgctgaaaccgctattcgtttcccgcgcaccgcaacgccgcaacggtggcgcagcgcacaaggacaccatctacggtcaaccggaaaaattgaagaaaaacggaagcgttacgcagaaggttgcactcaccagcctgacgttgaaagacatcgacttgctcgccgacccccaccgcaacgcaaagctgtacggggccattcgcgaacgcctcgaagcccacggcggcaagggcgacaaggcatttccggccaccaatccgctacgcaagccggacaaggaaggcaacccgaccggcccgatcgttcgtacggtgaccaaagtcatcgacaaactctccggcatcccggtgcgcggcggcattgccaagaacgacaccatgttgcgggtggatgttttcaccaagggtggcaagtttcatctggtgccggtttatgtgcatcaccgtgtgaccgggctgccgaatcgggcgattatcgcgttcaaggacgaagatgaatggacgctgattgatgacagctttgattggtgtttttcgctgtatccaaacgacctcctacgcatcaagctaaaaaaagaaagccactctgggtattactccagctgcaatcgatcaactggcgcagtaaatctttgggcacatgatcgtaatgtaaatgtgggcaaagatggtttcatcgaaagcatcggcgtcaaaatggctgtttcaatcgaaaaactccacgtcgacaccctgggcaacatctaccccgccccaccggagaagcgtcgtgggctggcgtag

SEQ ID NO: 25 - DNA, 3414 bp, Nitratifractor salsuginis
atggaggatcggatcgtgaaaaaaattctgggcgttgatctgggcattacctcttttggttatgccatcctgcaagagactggaaaagatctatatcgatgtctggataattctgtcgtaatgcgcaacaacccctatgacgaaaagagtggcgaatcgtcccagtcgatacgttcaacccaaaagagcatgcgtcgcctcatagagaaacgcaaaaagcgcatccgatgtgtggcacaaaccatggaacgttatggaattcttgattattcggagacgatgaagatcaacgaccccaaaaacaatcccatcaaaaaccgatggcagctccgtgcggtggatgcctggaagcgtccacttagcccgcaagagctcttcgccatcttcgcccatatggccaaacacaggggatacaaatcgatcgctacggaagatctcatctatgaactggagcttgagctcggtctcaacgacccggaaaaagagtcggagaaaaaagcggatgaacgacgccaagtctataacgctctgcgccatctggaggagctgcgtaaaaaatatggcggagagaccatcgcccagacgatccaccgggccgtagaggcaggtgatcttcgttcctatcgaaaccatgacgattacgaaaagatgatccggcgcgaagatatcgaagaggagatcgagaaggtccttcttcgccaggccgaactgggagccctcggactgcccgaagaacaggtttccgagctcatcgacgagctcaaagcctgtataaccgaccaggagatgcccacaatagatgaatccctttttggcaaatgcaccttttacaaagatgaacttgctgctccggcatacagttatctctacgatctctatcgcctgtacaaaaaacttgccgatttaaacattgacggctatgaagtgacacaggaagaccgggaaaaggttattgaatgggtagaaaagaaaatagcccaagggaaaaatctcaaaaagattacccataaggatctgcgtaaaatcctcggactcgcccctgagcaaaaaattttcggtgtggaagatgagcgtattgtcaaaggcaaaaaagagccccgaaccttcgtcccctttttctttctcgcagatatcgcgaagttcaaagagctttttgccagtatccagaaacatccggatgccttgcagatattcagagaactggccgagatcctccagcgttccaaaaccccgcaggaggccctggatcggctacgtgccttgatggccggaaaagggatcgacacagacgaccgggagctgctggagctcttcaaaaacaaaagatccggaacacgtgaactctcccatagatatatcctcgaagcactgccccttttccttgaagggtatgacgaaaaagaggtccagaggatccttggattcgatgatcgtgaagattactcccgttatcccaaatccctacgccatctacacctacgggaggggaatctctttgaaaaagaggagaatcccatcaacaaccatgctgtcaaatccctcgcctcctgggcgttggggcttattgccgacctgagttggcgttatggccccttcgatgagatcatcctggaaacgacccgggacgccctcccggaaaagatccgcaaggagatcgataaggccatgagagaacgggagaaagctctcgataagatcatcggcaaatacaaaaaagagttcccctccatcgataagcgtttggcaaggaagatccagctctgggagcgccaaaaaggactcgatctctacagcggaaaggtcatcaacctttcccagcttctcgatggtagcgccgatatcgaacatatcgttccccaaagcctgggcggtctgagcacagactacaataccatcgtcacgctcaaaagtgttaatgcggccaaaggcaaccggctccccggcgactggctcgccggaaatcccgactatcgggaacggatcgggatgctctctgagaaggggttgatcgactggaaaaagcgaaaaaacctccttgcccaatccctcgacgagatttacaccgaaaatacccatagcaaggggatccgcgccaccagctatctcgaagctttagtcgcccaggttctcaaacgttactatccttttccggatcctgagctgagaaagaacggcataggggtccgaatgatccccggcaaggtcaccagtaagacacggtctctccttgggatcaaatccaaaagccgggagaccaatttccaccacgccgaagatgccctcatcctctcgaccctcaccaggggctggcagaaccgcctccatcggatgctgcgagacaattacggcaaaagcgaagcggagctcaaggaactctggaaaaaatacatgcctcacatcgaggggctcaccctggccgactatatcgacgaagcgtttcgccgcttcatgtccaaaggggaagaaagcctcttttacagagacatgttcgacacgatccgcagtatctcctactgggtggacaagaaacccctctccgcctcctcccataaagagaccgtctattcatcccgccatgaagtccctactttgcgtaaaaatatcctcgaggcttttgacagcctcaatgtcatcaaagaccgccataagctcacgacagaggagtttatgaaacgttatgataaggagatccgtcaaaagctatggctgcatcgtatcggcaataccaacgacgagagctaccgtgccgtagaggaacgggcgactcaaatcgcccagatactcacccgttatcagctcatggatgcccagaacgacaaggagatcgatgagaagtttcagcaggcgctcaaagagctcattacctcccccatcgaagtgaccggaaaactgttgaggaaaatgcgtttcgtttacgacaagctcaatgctatgcagatcgaccgggggctggtagagacagacaaaaatatgctgggtatccatatctccaagggccccaatgagaagctcatcttccgtcgcatggatgtcaacaacgcccatgaactccaaaaagagaggtccgggatactctgctatctcaatgagatgctttttattttcaacaaaaaaggcttgatacattatggttgtctgagaagctatctggagaaaggtcaaggttccaaatatattgcactattcaacccgcgattcccagccaatcccaaagcccaaccctcaaaatttacttcagacagtaaaatcaaacaggtaggtatcggcagcgctacaggaatcatcaaggcccatctcgatctcgacgggcatgtcaggagttatgaggttttcggcaccctgcccgaagggtccatagagtggttcaaagaggagtcgggctatggccgcgtggaagacgatccgcatcactaa

SEQ ID NO: 26 - DNA, 3405 bp, Enterococcus cecorum
atgaaatatatagaaagcgtttcgattgggtttgatattggcgtgggatctgttggttatgctgttattaattctaaaacgaaacaaattttagaaagcggtgtaagtatttttcccgcagcagttgcacaaaagaatgttgaacgtcgtgagtctcgtcaatcaagacgtttgagaagaagacgagtcaatcgcttaaatgatttgaaaaaattactgaaaaaaaacggctttatcccatctcctaataaaaatccttatgaaattcgtgttagaggactagagcatcaattgagtagagatgagattgcgattgcggtgctacatattgcaaaacgtagaggtataagttattcattagatgatgttgtagacgagaatgttactgattttaaggggaaaattgcgaaaaatcaagaagcactaaagaataagacacctggtgagatacaatatgaacgtttgttaaaatacggtaaagttagaggtacagtcaccaattatgttgaatatgatgaacagccagagtattttttaaatgtatttcctaatagtgcttatgttgatgaagcaaaaagaatcttaacttgccaaaaacagtattatcctgaaattactgatgatttaatcgaaaatattgtcaaaattattagtcgtaaacgagcttattatattggtccgggtaatgaaaaatctagaactgattatggaatctatcgtacaaatggtgaaacgttagaaaatattttcgaaatccttattggtaaagatagtgttaatccagatgagctacgtgcaccagcaaactccttgactgcacaggtttataatttattaaacgatttaacgaatattcggtataatggatcggaaagattaactcccgaacaaaaacaagatattttatctgaattacttactacagaaaaaacagtacagatgctaaatgttattgctaaaaaagtaaatgtgaagaaggaagaaatttcaggattccgtaccaaaaaagatgataaacctgattttcatacattagaagtatatcgaaaagttcgaaaacatatgctaaataaaggaatcgatataaatgaatggccaacagaatgctttgatgagttagctttcattttcaatttaaatactgaaattggtgaaattagaaatcgtatttctgaaaaagtggtacctaaatatgattttatcactaatcaaattgttgatgatttacttgaagatcctaaaatttttgctatttcaacatcacaaaaatggcatcgtttttcaattaaaacaatgaatgtcttaatacctgaattattaaatggttataatgaacaaatgactattctaacaaggatgggattactggaagatagtaagaatgattactcaaacattgataaaattgatattaaaaatgtaactgaaaatatttataatccagtagtgcgaaaatcaattaaaaaatgtttgaaaatctttaatgaactttataaaaaatacccaaatatttcagatgttgttattgaattaccgcgagaagataatcccgaagatgcaagaaaattaattaagaagatgcaaaaagaaaatcttgttgaaaaagatacatcattagaagcattcagaaaagaagcaaatttatcagaaaatggattaattgattttttaagaaaagggaaaaatcgcgcattaaagattcgtttatggtatcaacaagaaggaaaatgcttatatacaggtgaaccaatattagcagaggatttatgtaaaaatgaagcaaattacgatattgatcacattattccaatttcggtatcatttgatgacagtataaataataaagtcttatgttctagtcattttaaccgatttgaaaaagagaagaaaacgccgtttgaatattttagtaataaatcaagtcatttagggcgttatagtaattttgatgagtttagagctagtgttaatgcgaataaacgaattagtgatgttaaacgtaagaatttactgtcaaaagaattgttgtctgatctagatactcgtaaaaaatttattgcacgtaacttggtagatactagatatgcttcaagagttgtatttaatgaattgacacaattttttgcatccaagaaagctgatactaaggtggccgtaattcgtgggaaattcacttcgcaactaagacgtgcatggcaattaaataaatcaagggatacctatcatcatcatgcagttgatgctgctttaattggtgtaactcctttcttgaaaatttggcgctcagggaaaacgatatatccgcgtaaaatgactgaagcacaaactgattttgaattaaatgaaataactacaaatgatgaatttaaagaaagttattatcaactaccttgtccacaatttttagattatctaactcaaatgcaagaaaatctaaaaattaattttgaagttgataaaaaaatgaaccgtaaaatcagcgatgcaatgatttactcatctcgaaaaaagaaattgagtaaggataagaaagaaaaagaatattccttagggacaattaatgatatttattctgatgctggatatagtaaatttaagaatatctataagaaagataaggaaaaatttttaatgtatcatttggatcataagagttttgaaattttagaagatataatttctcaatatcctgacaaagaggaatatatcgattctgagggaaaggtgaaacaaagagcagtaagcccttttgaaatttatcgtcgtaaatatggatatattcgaaagtatagcaagaaaaataacggtccaattataaaaaatatgaaatattataatgagaacttacctaaaatatatatagatattactccaaaacaatcaattgataaaaaagtatatcttactaatatatcgccttggcgaacagatgtttactataatcgttctcaaaattcatatcatattatgggaataaagtattctgatttgaggtatattgatggcaagtatggaataccgaagaatgtgtacgaaaaaataaaattaagagaaaaaattcctagtgaatcagaattttgtttttcactttataaaaatgatagggttaaaatcattgatccaaataaaaacgaggaaatcgagttaagatttaattctagaacactaccttcagtgctaaactatgttgaatttaaaccattatttcaagaatcttataatagtttgacgcttcttccagtgttttcaaagactaccagtgaaggaagaataataaaaaaatttactagagaagataatatcgtttacaaagtaaatactgacgaactaggcaatccatattatattttaaaagaatcacaaaatcccaaaaatattattgacaactctaataagacggagtag

SEQ ID NO: 27 - DNA, 3429 bp, Facklamia hominis
atgtattctgttgggttagatattggtatagccagctgtgggtatagtatcattaacgatgtcaatggaaatattgtagaactcggcacccttctctttaagtcgcgaaatagtgataataatgaggagagaagaactaataggggttcaaggcgattaattaacagacgacgaactcggcttgatgatggtaaaaaattgttagcagaaaaaggatttaaacaagattccaaattaaaacatgtatgtccttatgaacttcgtgttaaggggttacatgaaaaattaacacagggggagatttataaagtagttctacatattctcaaaaaaaggggaattagttatttagatgaatcggatgaaaattcatctggaattgacggtgctagttataaagatcaagtaaatctaaatttaaatttgcaaaaggaattaactccaggtcaaattcaattaaaacgtttgaaggaaaatggtcgcataaaatcaggcgttacttttgaaaatggatatcaattaaatgtgttttctgtaagtgcttatgctaatgaattaaataagatattaacaaagcaatcagaatattattctgaaattgaccaaatttggatcgatcgtttcactaaaaatggttatcgtaaagaagcaggcctagtttatagaaaaagaccttattatgatggcccaggaaatgaaaagaacaactcaatttatgggcggtgggcaaattttaaagaggatggacaccctaaggagaatatatttgatcaattaattggattagactcagtggattcaacacaagtaagagccagtgcgtctactttgacagcacagaaatataatctattgaatgatctaaataacttaacaattatagaagatgatcgtaagtttacaacagatgaaaaagtttctattattaattatttaatgactcaagatataactcggtttggccccaaagaattagctaagttttatcaattagaagtggatcaaattagagggtggcgaattgacaataaagggaacccagaaatccattcattgaaggtatatagagattggaaaaaaatatttaatacatctagtattgatctaactagtattcaaacttgggtagttgatgagctggctaatgttattactttgaatacggaaattccatcaacattagctacattaaagataaagatacctgatatagatcagcagatattaaattttgttgagaataatttttatgaattaaagaaaaaaacaagtaaaaattcttggcatagcttttcgcttaaaaccctcaatattttaataccagaattgttaaatacttctgaagagcagaatactatattagaacgtttaaatctaaagttcgatttaaaaaataaatatgcagaaaaaaatcaaatacctgttaaggagcttctagaacaaatttataatcctacagtaaccaaatctgttcatcaatcaattaagttatttaatgaaattatagaaaaatatggaaaaaataatatatcttatgtaacgatcgaaatgccaagagataaaaacgatcaggatcaaaaagatactataaaaagaataaataaattaaatagtgaacgaaagaatgatagtgaaaaatattttttagaaagatcaggttgggatactattcgatttgagagtgcgttaaaaaaaccacgctttgcagagaagctactgttttattatgaacaaaaaggcaaatgtgcgtatagcggtcaggatattctggcagaatctttattgaatgaatcttgtgaagttgatcatattattccgttatcaataagttttgacgattcgatccataacaaagtgttagttactgcaagctctaatcaagaaaaaggacagagaacaccctatatggcattcattgatggagcgaagttggggcaaagttgggatgactttgtcgcttgggtaaactcatgtggattccatcgaaaaaaggttcaaaatttactttatgaggagaatatttttaacccagatgtgcaaaggggatttgttagtcgtaatttaaacgatactagatatgccagccgaattgtgttaaatgctatacaaagcttcttttataaacagaaagatttgaccaaagttaaagttgtgaatgggagttttacacatactctaaggaaaaaatgggggagtagcttagataaaaatcgggatacataccatcaccatgcggttgatgctactttgtgtgcagtaacgccttttattaatatagtaaaatatgagttttttgaagaagatggaataaaatatatggttgatttaaccacgggagaaaaagttgcatatagtgattataaaaaaatgaagttttatgataaaagggcatatgtccccatttgggatgggtttattaagcagttaacacctgcaaatttatatccaaagattaagttttctcatcaagttgattccaaatggaacagaaaaattagtgatgcgacgatctattctacaagaaaaattgtagagaccaagattaataaaaaaggagtcgctaaagaaactgtaaaagatatagtcattgataaaataaaagacatatatactcctgaggggtggaggaaatttaaagagaaacaagataaacttcttatgaagaactttgatgaaaaaacttataataagttaataaagatagcaaaagaatatccagaaaaaaaagaagttcaaacatcaaatgggaaagtaagtcttgttgaggtttcaccatttaaaatgtattgcgaagaacagaatgttcctgcaatacgaaagtattctaaaaagggcaatgggccttatattcgttctttaaagttttacgataaggaactagggaagcatattaatattacaaaagattcttatggaaatgatattgagcgaacaatcagaaataaaaagatcattttaaaaaatcaaaactcctggagaactgatgtttactataattctgtaaataattgttatgaattattgggtattaagtactgtcaccttaaattttaccgaggaaaatatggtataccaaaatcgatctatgatgaattaaagaaagaagatgagatttcctcagaaagtgtttttaaatttagtctgtatagacatgatagagttcgattcgaaaaagatggtgagtatattgaagctttatttggatcaaaaaatgaatcgaataaaaattatttagaactgagtccaattgacaaaaataaatggttatcaaaagagaatgttaagttttttggagaggtggctgcatcaggacgatttataaaagggctaaagcctggtattaaagtgataaaacagtcgacagattatatgggacatgtatacgccattcatcaggaaaaattaaaatttgttttgtcggatgcttga

SEQ ID NO: 28 - DNA, 3369 bp, Streptococcus sinensis
atgaacggaaaaattttaggattagatatcggtgtggcttccgtcggtgtcggaatcttagacaaaaaaactggtgaaattattcatgctagttcacggattttcccagcggctactgctgacagcaatgtagagagacgaggttttcgccaaggacggagactaggacgcagaaaaaagcatcgaaaagttcgcctagctgacttgtttagtgatacgggtcttataacagatttttcaaaagtatccatcaatttaaatccatatgaactgcgcattaagggattaaatgagaaattaactaatgaagaattattcattgctttgaaaaatattgtcaaaaggagagggattagttatcttgacgatgctaatgaagatggtgagtcttcttcctcagagtatggcaaggctgttgaagaaaatagaaagctgctcgcagataaaacaccgggacagattcagctggaacgttttgagaaatacggacaggttcgaggtgattttactattgaagaaaatggggaaaaacaccgtctgcttaatgtgttttctacctcagcttataaaaaagaagcagagcgaatcttgacaaagcagcaagactataatcaagatatcactgatgaatttattcaggcatatttaacgattttaactggaaaacgtaagtattaccatggaccagggaatgaaaagtctcgtacggattatggacgcttcagaacagatggaacaactttggataatatttttggtattttgattgggaaatgtaccttttatccagaggaatacagagctgctaaagcttcttacacggcacaggaatttaatttactcaatgatttgaacaatctgactgttccaacagaaactaagaagcttagtgaggagcagaagagacaaattattgagtatgcaaaaggagctaaaactttaggtgctgctactttgttgaagtatatagcaaaattggtcgacggatctgtagaggacataaagggatatcggattgataaaagtgaaaaaccagaaatgcatacttttgatatttatcgaaaaatgcaaacattggaaacggtcgatgttgagaaactatctagagaagttttagatgagttggctcatatcctcacactcaatacggaacgtgaaggaatcgaagaagcgattaaagtatcatttatcaaaagagaatttgagcaagatcagattgctgaattagtttcatttagaaagtctaatagttccttgtttggaaaaggctggcataatttttcaatcaaattgatgacggaattgattccagagctgtatgaaacatctgaagagcaaatgacaatccttacacgattgggaaaacaaaaaacaaaggcaagatctaaacgaaccaagtatattgatgagaaggaattgaccgacgaaatttataatccagtagttgctaaatcagtcagacaagcaattaaaatcattaatcttgctacaaagaaatatggtgtctttgataatatcgttattgaaatggcgcgtgaaaataatgaagaggatgcaaagaaagactatgtgaagcgtcaaaaagccaatgaagatgagaaaaatgctgcaatggaaaaagcagctcatcaatataatggaaaaaaagaactaccagataatgtctttcacgggcataaggaattggcgacaaagattcgactctggcatcagcagggagaaaaatgtttatatactggaaaaaatattccaatcagcgatttaattcacaatcaatataaatatgagattgatcatattttgccactatctctttcatttgatgatagtttagcaaataaggtactagttttagcaacagccaatcaagagaaaggacagcgcacaccattccaagctctggatagtatggatgatgcatggtcttatcgagaatttaaagcttatgtgagaggagccagggcactcagtaataaaaagaaagattacttgctgaatgaggaagacattaacaaaattgaagttaaacaaaaatttattgagcgtaatctagttgatactcgctattcttctcgagtagttttaaatgctcttcaggatttttataaattaaatgattttgataccaagatttcagtggtgcgtggacaatttacttctcaacttagaagaaagtggcggattgacaaatcgcgtgaaacttatcaccatcatgcagtcgatgcattaattatcgcggcttccagccaattaagactttggaaaaagcagggtaatcctctaatttcgtacaaggaaaaccaatttgtggattctgaaacaggggagattatttcattgactgacgatgagtacaaagaattggtatttagagctccttatgatcattttgttgatacggtaagcagtaaaaaattcgaagatcgtattttattttcctatcaagtggattcaaaatataatcgtaagatttctgatgcaacaatttattccacaagaaaagcaaagttgggtaaagataagtcggaggaaacctatgtattgggtaagattaaggacatatatactcaaacgggctatgacgctttcataaagctttataaaaaggataaaagtaaattcctgatgtaccataaggatccaataacctttgaaaaagtcattgaggagattttaaaaacttatcctgataaggagataaatgaaaaaggaaaagaagttgcttgcaatccctttgagaaatatagacaggaaaatggtcctcttcgaaaatatagtaaaaaaggaaaaggtccggaaatcaagagtctgaaatactatgataacaaattaggaaatcatatagatattaccccagataatagtgagaatcaggttatattacaatctttaaaaccctggcgtacggatgtctattttaatcataagacgaaaatatatgaattgatgggattaaaatattcagatttatcttttgaaaaaggaagtggaaaatatagaatatctttagataagtataatgttattaaaaagaaagaaggtgtacacaaggaatcagaatttaaatttacactctataagaatgatttgattttaataaaagatttagaaaagagcgaacaacaattattccgttataattcaagaaacgatacatcgaaacactatgttgaattgaaaccctatgataaagctaaatttgaggggaatcagcctctaatggccttatttgggaatgttgctaaaggaggacagtgcttgaaaggtttaaacaaagcgaatatctccatctacaaagttcaaacagatgttttagggaataaacgttttatcaaaaaagagggtgatgctccaaaactcgaattttaa

SEQ ID NO: 29 - DNA, 3276 bp, eubacterium dolichum
atgggcagattagtattgggattagatattggtattacttcggttggatttggaattattgatttagatgaaagtgaaattgtagattatggtgttcgtttatttaaagaagggacagctgctgaaaatgaaacaagacgtactaagcgtggcggcagaagattaaaacgaagaagggttactaggcgagaggatatgttgcatttgttgaaacaagctggtattatttcaacttcttttcaccctttaaataatccttatgatgtacgtgtcaaaggactgaatgaaaggttaaacggagaagaattagccacagctttattgcatctttgtaaacatagaggaagtagtgttgaaacgattgaagatgatgaagcaaaagctaaggaagcaggagaaacgaaaaaagttttgtctatgaatgatcaacttctgaaatccggcaagtatgtttgcgagattcaaaaagagcgattgcgtacaaatggtcatattagagggcatgaaaacaactttaagacaagggcgtatgttgatgaagcttttcaaatacttagtcatcaggatttatctaatgaactgaagtcagcgattataactatcatatcacggaaaagaatgtattatgatgggccgggaggtccactatctccaacaccttatggacgctatacatattttggacaaaaagaaccgattgatttaattgaaaaaatgcgtggtaaatgtagtttatttcctaatgagccacgtgcacctaagcttgcatatagtgctgagttatttaatttgttgaacgatttaaataatttatctattgagggagaaaagctaacatcagaacaaaaagccatgattttgaaaattgttcatgaaaaaggaaaaattactccgaaacaattggcgaaagaggttggcgtatcgttggagcaaattcgtgggtttagaattgatacgaagggaagtccattattatctgaattgaccggttataaaatgatacgtgaagtcttggaaaaaagtaatgatgaacatttggaggatcatgtattttatgatgagattgctgagattttgacaaagacgaaagatatagaaggaagaaaaaagcaaataagcgaattatcttctgatttgaatgaagagagtgttcatcaactagcaggcttaactaaatttactgcgtatcattcactatcttttaaagcattgcgattgattaatgaagaaatgctaaaaacagaattgaatcaaatgcagagcatcacattattcggtttaaaacaaaataatgaactatctgtaaagggaatgaaaaatatccaagcagatgatactgctattttaagtccggttgcgaaacgggcacaacgtgaaacctttaaggtagttaatcgcttgcgtgaaatttatggtgaatttgatagtatcgttgtagaaatggcacgtgaaaaaaacagtgaagaacaaagaaaagcaattcgtgaaagacaaaaattctttgaaatgcgtaacaaacaagtagcagatattatcggagatgatcgtaagatcaatgctaaacttagagaaaaattggttctatatcaagaacaagatggtaaaacagcgtattcgttagagcctattgatttaaaactattgattgatgatccaaatgcttatgaagtggatcatatcattccgatttctatttctttagatgattctataacaaataaagttttagttacacatcgtgaaaatcaagaaaagggtaatttgacaccaatttcagctttcgtaaagggaagattcacaaaaggatccttggcgcaatacaaagcatattgtttaaagctgaaagaaaagaatataaaaacaaacaagggatatcgaaagaaagttgaacaatacttgttgaatgagaatgatatttacaagtatgatattcaaaaagaatttatcaatcgtaatcttgtagatacaagttatgcaagcagagtggttttgaatacattgactacttactttaaacaaaatgaaattcctactaaagtatttacagtcaaaggttctttaacaaatgcatttagacgaaagatcaatttgaaaaaggatcgtgatgaggattacggacatcatgcgattgatgcattgattattgcatcaatgccaaagatgcgcttgttaagtacgattttctcacgttataaaattgaagatatttatgacgaaagcaccggagaagtattttcatcaggtgatgacagcatgtattatgatgatcggtattttgcctttatcgcaagcttaaaagctattaaagtaaggaagttctcacataaaattgatacaaaacctaatcgcagcgtcgcagatgaaacaatttacagtacacgtgtgatagatggtaaagaaaaagttgtgaagaaatataaagatatctatgatcctaaattcacagcgttagctgaggatattttgaataatgcctatcaagaaaagtatttgatggcgttacacgatccacaaacatttgatcaaatcgttaaagtggtcaattattattttgaagaaatgtcaaagtcagagaaatactttactaaggataaaaaggggcgcattaaaatttctggaatgaatcctttgtctttgtatcgtgatgagcatggtatgctgaaaaagtattctaagaaaggagatgggcctgcaattacacaaatgaaatattttgatggtgtattaggaaatcatattgatatttcggctcattatcaagtaagagataaaaaagttgttttgcaacaaatttccccatatcgaacagacttttattattctaaggaaaatggatataaatttgttactatccgttataaagatgtaagatggagcgagaaaaagaaaaagtatgttattgaccaacaagactatgcgatgaaaaaagcagagaagaaaattgatgatacatacgaattccaattttccatgcatcgtgatgaacttatcggaattaccaaagcagaaggagaagcgcttatttatccagatgaaacttggcataactttaacttcttttttcacgctggagagactccggaaattttgaagtttacggcaacgaataatgataaaagtaataaaattgaagtaaaaccgatacattgttattgtaaaatgcggttaatgccaactattagtaagaagattgtacgcatagataaatacgctactgatgtagtaggaaatttatataaagtaaagaaaaataccttgaaatttgaatttgactag

SEQ ID NO: 30 - DNA, 3393 bp, Streptococcus macedonicus
atgacaaatggaaaaattttaggtttggatattggtattgcatctgttggtgttggtattattgaagcgaaaactggtaaagtagtccatgctaattcacgtcttttttctgctgcaaatgcagaaaataatgcagagcgaagaggattccgtggctcaagacgcttaaatcgtcgtaaaaaacaccgtgttaaacgagttcgtgatttatttgagaaatatgggattgttactgattttagaaatttgaacttaaatccttatgaacttcgtgtaaaagggttaacagaacaacttacaaatgaagagctatttgctgctttacgaacaatctcaaaaagacgagggatttcatacttagatgatgcagaagacgattcaactggtagtactgactatgcaaaatctattgatgaaaaccgtcgcttgctaaaaaccaaaactcctggtcaaattcaattggaacgtttggaaaaatatggtcagttacgaggcaattttactgtttatgatgaaaatggtgaggctcatcgattaatcaatgttttttcaacttctgattatgaaaaagaggcacgtaaaattttagaaactcaagcggattacaataaaaaaattactgctgagtttattgatgattatgttgaaatcttgactcaaaaaagaaaatattaccatggaccaggtaatgaaaaatctcgtacagattatggacgttttcgcacagatggcacaacgctcgaaaatatttttggcattttaattggtaaatgtagtttttatcctgatgagtatcgtgcctcaaaagcttcttatactgcacaagaatataactttttaaatgatttaaacaatttaaaagttccaacagaaactggtaaattatctactgaacaaaaggaagctttagttgaatttgctaaaagtactgcaacgttaggtcctgctaaattattaaaagaaattgctaaaatactagattgtaaagttgatgaaattaaaggatatcgtgaagatgataaaggcaaaccagacttacatacatttgagccttatcgaaaattaaaattcaacttagattcagttaacattgattatttatcaagagaagtccttgacaaattagctggtattttaacacttaatacagaacgcgaaggtattgaagatgccatcaagcgtaatttgccaaatcagtttactgaagaacaaatctctgaaatcattaatgttaggaaaagtcaaagcacagctttcaataaaggttggcatagtttttcagctaaactaatgaatgaattaattcctgaattgtatgctacatctgatgagcagatgacaattctaacaagattagagaaattcaaagttaagaaaaaatcatcaaaaaatataaaaactattgatgaaaaagaaatcacagatgaaatttataatccagttgtagctaaatctgttcgacaaacaataaagattattaacgcagcggttaaaaaatatggtgattttgataagattgttattgaaatgccacgtgataagaatgctgatgatgagaagaaatttattaataaaaggaataaggaaaataagaaagaaaaagatgacgctttaaaacgtgcagcttatctttataatggtactgataaattacctgatgaggtctttcatggaaataaacagttagaaacaaaaattcgactttggtatcaacaaggtgaacgttgtttgtattctggcaaaccaattccaattcaagagttagtacataattcaaataattttgaaattgatcatattttacctctgtcgctttcttttgatgatagtttagcaaataaagtattagtttattcttggacaaatcaagaaaaaggacaaaaaactccttatcaagtaattgattctatggatgcagcatggtcatttagagaaatgaaagagtatgtcttaaagcaaaaaggacttggaaagaaaaagcgtgactatcttttaacaacagagaatatcgataaaattgaagttaagaagaaatttattgagcgtaatttagtagatactcgatacgcatcacgcgttgtccttaatagtcttcaatctgcattaagagagttgggcaaagatactaaagtttctgttgttagaggtcaattcacctcacaactacgtcgaaaatggaagattgataaatcgcgtgaaacataccatcatcacgctgttgatgctttgattatcgctgcttccagtcaattgaaattgtgggaaaaacaagacaatccaatgtttgtggattatggaaataatcaagttgttgataaacaaacaggggaaattttgtccgtttctgataatgaatacaaagaattggtattccaaccaccatatcaaggttttgttaacacgatttcaagtaaaggatttgaggacgaaattttgttctcttatcaagttgattcaaaatataatcgtaaggtttctgatgcaactatctattcaacacgaaaagctaaaattggaaaagataaaaaagaagaaacttatgttttagggaaaatcaaagatatttacagtcaaaatggatttgatacctttgttaagaaatataacaaagataagacacaattcttaatgtatcaaaaagatcctttaacatgggaaaatgtcattgaggtgattcttggagactatccaactacaaaaaaatctgaagatgggaaaaatgatgtcaaatgtaatccatttgaagaatatcgtagagaaaacggcttaatctgcaaatacagcaaaaaaggaaaaggcacaccgattaaatctcttaagtactatgataaaaaattaggaaattgtattgatataacacctgaggaaagcagaaataaagttattttacaatcaattaatccttggagggcagacgtttactttaatccagagactttaaaatatgaactgatgggattaaaatattctgatttaagttttgaaaaaggaactggtaattatcatatttcacaagaaaaatatgatgcgataaaggaaaaagaaggcattggtaaaaaatctgaatttaagtttactctttaccgaaatgatttgattttgataaaagatatagctagtggcgaacaagaaatttatcgctttttatctcgaacaatgccaaatgtaaatcattatgtggaattgaaaccatatgataaagagaaatttgataatgttcaagaattagttgaagctttgggagaagcagataaagttggacgttgtataaaaggtttaaataaacccaacatctcaatatataaggttcgcacagatgttcttggtaataagtattttgttaaaaaagaaggtgacaaacctaaattggattttaaaaataataaaaaataa

SEQ ID NO: 31 - DNA, 3324 bp, Turicibacter sp.
atgggatatacactaggcttagatattgggattgcatcagttggatttggtttaattgacaatgttgatgggaaaattttagaatcaggagttcgtttgttttcttctgctgatcctgataataatcaaacacggcgtagctccagacaggctagacgtcttaatcgtcgaaaggtgcatcgtttagaacgagttgcgcacttgttagaagaggctggttttgaaaaaggagaggttttagctcctacgccttatcatttacgagtaaaaggattaacggaaaagttaagtaagccagaagtttatgctgctttatataatttaatgaaacatcgaggaatttcttatttagaagatgttgagttagatgaggcagatagtagctctgtgagccaaaatgttgagttattaaaagagtattatccatgtgaaatccagttagaacgttatgaagaatatggccaaattcgagggattattgaaacttataataaagatggtgaaaaagagtcattggttaatatttttccaactggtgcttataaaaaggaagctgaggcaatcatcttaaaacaaggtcagttttatcctgagttagataaagtgtttttagaaaaattcacggaaattttaacagttaagcgcccttattatgtagggccaggcaacaaaaagtcacgtactgattatggaatctatcgtgaaaatggagaaactctagagaatttatttgatattttaattggaaaatgtacgatttatccacaagaggcacgtgctgctaaattttcttatacagcccaattgtttgactttttaaatgacatgaataatatttctattgctggtgagaagttaacggaagttcaaaaacgtgaaatttatcatcagattatgtcatcaaaaacagtgaatatgatgaagattataacgaaagttacaggttgcctaaaagaagaagtgacggggtacagggtagatagtaaatataaagccgaatttcattcatttgctagttatcgtcaatttagaaacaaaatgttagattatggttttgatgttcaaacgttaaatgttgaaatgtttgataaattggcggctaaactaacattaaatacagaatatcatcaaattattactcagttggaatcgcttaatttaggattaagcaaagagttaattgaaaaaatagctgattttagaaagaaaaacaggtctcttttctctaagtggcacagtttatctttgaaagctatgaatgaagttgtagatgaattgtggtcaacatctaaaaatcagatgcagatatttagtgaattagggggttttaaatcaaatatagaagtttttaaaggactgaaatatattcctttagacgcaatggtcgatgaaatttataatcctgtcgttagatgttccatccgtgaaagtataaagattattaatgccttactaaaaaaatatggggctttagataaagtagttattgaaatgcctcgtgatagtaatgaaaaagaagaaaaagatcgtattacaaaattaaataaagaaaatgataataagaagaaacaggccattgagaaagcgagaaatgaatatggatttggggaagaagcttatcgtcagcagaatgatttaaatacaaagttgcgtttatggtatgaacaaaaacaaagatgtttatatagtggagaaataattaaaatatttgatttaattaaaaatccacatttatttgatattgatcatattattcctaaatcaatttcttatgatgatagtttatcaaataaagttttatgttatgcgactgaaaatcgtgaaaaaggaaatttaacaccgtatcgttattttaaaagaaaagcgagtttaacttggaactatgaggcttataaaagttatgttattgaattatacaaagatggaaaaggtgatcttagtcgcaccaaactagaattattgctttttgaagaggatattaataagtatgaagttcgtcaacggtttattaatcgtaacttagttgacactcgttatgcctcaaaggttgtcttaaatactttacaagattttatgaaagaaaattatcctactacaactgtagaagttgttcgaggaaagtttactgctcagttaagaagacactggggaattagaaaaaatcgtgatgaaaatcatgcacatcatgcgattgatgccttaattattgcttgtgtaccacatttatcattatggaaagaacaaaagaaggtatttagtacagatgaatttagagttgatgaaacaactggcgaaattatcgaacaaagttataatcaacttacatatcaggaaccatttagtcaatttttctatcaacttgaaaaagtatcgattgattgtcgttactcatataaagtagatcggaaatttaatcgtcaagttgcggatgcaactatttattctacaagacaggggatagtcaaacaaacgagcggtgacaaaagttttactcttgattcaaatagtaaagagcattatgttatcgcaaaaattaaaaatatttacgaagatgtagatgctaaacgatttatggatcgatataaaaaagataaaactcaatttttaatgtatcatcatgatcctcaaacattttctattttagaggatgtgatgaaaacttatcctgataaaaagaatccatttcaagcctatcgattagagtatggaccaattagaaagtatagtaaaaaaggaaatggacctcagattcaaagtattaaatattatgattcaaaattaggacaacatattgaattaaaacaagcaaatcaaagtactaaaaaagttgttttgcagtcgttaaatccatggcgttgtgatatttattataataagaaagacaaaagatatattgcagcagggttaaaatatgctgatttgtcatatcaaaaaggaacaggactatatggtatttcacttcaaagatatcaacaaattttgaattctgagaaaatcgaattaagtatagaacaaattgaattattattggagggaagactaaacgaatcaaattttgagttttgtttttcactttataaaaatgattttattcaatggaatgatgagaataatcaaacctttcagtatcgattcttagctcgtaatttgagtagccctaatcgaatagaggtaaaaccaattaataagtcaaaatatgataaacaagctgaaggtttgaaaacgttaaagaaaggactaaataggttctataagatctcagttgatgtattgggatatcaacattttattaaaaaggaaaaattaaaattaacgttcaaataa

SEQ ID NO: 32 - DNA, 3195 bp, Bacillus niameyensis
gtggaaaaattgagaagggtgttggggcttgatattggtgtttcttccgtcggatgggggatcattgaccaagacagtggagatgtcattgacgctggggtaagactgtttgaagaggctgcacgtaatgctaatgaggatcggcgaagttttcgtagttcgcgcagattgaagaggcggaggacacaccgtttggaaagagcaaaaagtcttttcgagtacaatggattaccttctgaatcaattgggaaaatggatccataccaagctaggtataacgctatttttggagaggtatctaaagaagaattagttgcagggttataccacttagtaaaaagaagaggaacaacgcttgactcacccgaagatgaaaaatcgagcggcaatgaactatcgactaaagaacaattatcaaggaataggaaatttctagaaaaccgttatatctgtgaagtccaattggaacgtctttcaaatggtcatgaaaaaattagaaatcatgaaaataggtttcgcacagaggactatgtgaaagaagcacgtgcgatattgataagacaacaacaaagatattcggaaattacggatgaatttattgaggattttatcaatatcttaaaatcaaaacgtgaatatttcgatggtcctggatctgaaaagtcaccaaccccctatgggcagtattatttagataaagacgggaaattagcctatacatccatgattaacaagatgcgtggaatatgtacatattttcctgaccatcttcgcattgcaaaaatgtcatatacagccgacttatataatcttttaagtggcgatttaaacaaattattgatcaatggtgaatatctcacttatgaagacaaactttacttgattgatcattttatcaaaaagggcaaaaatattacccttacacaaattctaaagtataaaggtatttcggatgattcagatgtgagtggatatcgtattgatttgaaaaccgacaaaccaatttttacggaatttacaggattcaaagaacttaaaaagatcgtagacaaaaatgatttgccttcatccatcctagaggacatagatttaattgacgacattattgaaatattaacggcagaaaaatcttattacaggcgagaagagcaattaaagccattgttttcggaatatgatcaagaaactattgatagaatagttaatgcttttaaggaaagtacctcctttaagggttaccacgccctatcaaaaaaagcaattgaactaattttagaggatctatggtacacaaacaaaaatcaaatggaattgtttgcggaaagaaaactagaggaaaaacgcctttctgacttgaagactcaaacaaaagttatgtttgatggtgatgctattcttagcactgttgcaaaaagggcgcatcgtgaggcaattaaaatagtcaatgaagtgcgtaaaagatacggcgaaatggatgccattgtaatagaaacagcacgagagaaaaatagtgaggaaaaaagaaaacaatattccgattttcaaagagagatcggtaagcatgaaaaagaaatggccaaacttttaggagtgaaatcattaaaagatcttcggcttaatagcaaacaacatctcgcattaaaactttgggtgtctcaggatagaaaatgcatttattctggtagaagtatctcaattaatgatattgtacaggatccctcaaaatttgaaattgaccatatattacctgtttcactatcctttgatgatagccaagcaaataaagttctttgttatcacagagaaaatcagaaaaagggacaaaaaacaccttttcaatatttttcaactggacaagcatcacgttcgtttgaccagtttaaggtagaagttttgaacttatataagagtaggaaaatcaataacaagaaaaaggattacttgcttgaaatacgagatattgctcataatgaggaattacaaaaagaatttattaatcgaaatctagtagatacacagtacgcaatgcggagcttttctatgtctcttcgtactttctttaacagtcataatattgatacgaaggtgttatccattaggggatcctttactgcagcttttagacgaagggctagattaaataaggacagagaagaaagtcatgcccatcatgctattgatgctctgattgttgcggcaataggacgtatgcccatttttgagttccttaaagagtttgatatgagtgaagaaggtgttgttgttaatagagagactggagaaatattggaagagaatgagttttttaaacataaatacctctcttttatacgaaatctaatgaattatgaatctaaggtgaaatattctcataaggtcgatcgtaaagtgaatcggactatgtcgaatcagacgatttatggaacgagggagaaagatggagacacgtattatcttgggaaggtatctaatatttacaatctggataaacatggtgttgaaccattattaaagagacttgagaaaagccctaatagctttcttattgctgaacataatccaaaacttttcgaattgatacagcttattgtaaaagaatataaaaatgcggataacccttttaaagcttattataatgatcatggttatgttatgaaggatggaaaagttccggtgaaaactttaagatatcgtgatcgtaagttgggtgtccacatgaaaatcacggataagtatccaggtgctaaaagcgatgtggtcttactaagcattaagggggttagggtggatctttataagaatgctgaaggtaagtataaatatttgggcgtcccttatcattggtttaagcagcaagggaataaatatgtattagacatggaaaagtacaatgaggaaaaaatgaaggattataagaagattgatgacacatttgagtttcagatgagcctttataagaatgatttattttcttttgaaaggaaagaaggttcttactttaggatttttagaggagatgcgatgccgagggacaataaaatagaggttgatttcatagataagaaaaaacaagatcgaaaagacggctttctatccccatccacatttaaaaacatagttaagtataatgtcgatgttttaggcaatacttataaagtggaaaaagaaaatttcaaaaacactttacaactatag

SEQ ID NO: 33 - DNA, 3192 bp, Massilibacterium senegalense
gtgctcgaaaattatattttaggtttggatattggtattggttcagttggatatggtcttattgatgaaaatcaaaatattatagatgctggggtacgcttgtttccagaagctgatgtaaacaacaataatggtaggcgagaaaaaagaggagcccggcgattaaaaagacggaaacaacatagagttgctagagtaaaacatctgttagttaaaaatagaattatggcagaagatgcccaacctatctcaaataaaccttatgaaataagagtaaagggattaagcaaagagttaactgatgaagaactagctattgcgcttatacatatcgcaaaacgaagaggtattcacaatgttgaaacaactcttgatgaacaaaaggacgataatgaactttctactaaagaacaaattagtaagaatgaaaagttattaagaaataaatttgtttgtgaattacaattacaaagacttacaagaaataaagaaaacgaaataccatataaagttaggggttaccaaaatcggtttaaaactagtgattatattaaagaagttcagcagatattaaatacacagagacagtataataaaaaaataactgatgaatttattgagcgatatatagagttaataaagaagagacgtgaatattttgaaggcccaggagaaggtagtgagtatggatggggtggtgaccctcgaaaatggtacgaacagttaatggggaaatgtagctattttcctgaagaattgagagctgttaaggccagctactctgcacaattattcaatgcactaaatgatttaaataatatagtgattatgcgagaagaaaataccaaattatcagcagaggaaaaaagacgattaatagaaaaggtttttaaaattcgaaaaaagcccacgctaaagcagattgcaaaagaagttggagtgaatttcgaagatatcaaaggttatagagttaatgccaagggagaacctatatttacttcttttgatttttatcatagtattaagactattacgcaacgtcatgaaataattgaaaatgataaaatattagaccaaatggcacggattttaactgttatgcaaacaccatcagaaaaaagagagcgtttaaaacaggaaattcctgaattaacaacgtccgaaatatcggaaatttcagaattaagattcacgtctacacatagtttatctttgaagttaatttatcttttactacctgaattgtggtcgaccacaaagaatcatatgcaaattttatctgaaatgaaattgaaaccaaaacgcatatcacttaaaggaagaaatcaaattccagtatcaatagtagatgagtggatattatctcctgttgtaaaacgtgcatttacacaatctattagaattgttaatgcaatcatcaaacgttatggtgaaccatctgagattgtgattgaattagcacgtgagagaaatagtgaagatcgaaagaaatttttatcaaaattaaatagaaagaatgcagcaatgaacgaagaggtaaaagaaaagatagaacaactaggcgtatatgataccaaaggattatttgaaatgattaaattatggcatttgcaagatggtcattgtatgtattctttaacaccaattcctttaaatgatttgtttttaaatcctaatcattatgaaattgatcatattattccacgctctatttcatttgatgattcaataaataataaggtacttgtaaagtatatagaaaatcagaaaaaaggaaatttaactccttatcaatacatgaatcgaaaaatagatggagtatcttatgataagtttaaacaacatgttttacaattagcaaaatcatctgataagatgtcaagaaaaaaacgagagtatttgcttgaagaacgtgatatcaataagtttgaagttcaaaaagaatttattaatcgtaatcttgttgatacaagatatgtaacacgagaattaatgaacttattaaagacctttttttctgaaaataataaaaatgtaaaaattaagtccattaacggatcatttactcattatttacgaaaattatggagatttaaaaaagatcgtaatatagattataaacaccatgcagaagatgcattaattattgcaatggcgggatacttatttagtaaaaaggaagtattagcaaaacaaaatctaatattatctgatcctcatattgttaataaagaaacaggcgaaattttaagtgaagatgattttactaaaacattcattgataaatatgaaaaagtggctactataaaaaaatatcaaaattataagtattctcatcgagtggaccagaagccaaatagacaattgatgaacgatactatttgttcaactagaacggtcgataacaatgaatatgttattaaaaaaattaaagatatttatgctaaggataatacagatttggttaataagattagaaagagtccaaaaaagcttctaatgtatcataacgatagacaaacttatgaaaaaataaaaagtatcatggagcaatatggggatgctaagaatcctttgtacaaatataaagaagaaacaggtgaatttgtaacgaagtatagtaaaaaagataacggtcccccaattctatcggtaaaatattatagtggaaaattaggtgagcataaagatatcacgcataaatttcataattctaagaaaagagttgttaatttatctataaagccatttcgaatggatgtatataaggaagatggcatctataaatttgtgactgttcgttttaatgatttaaaagaaaaaggagataattatgagatttgcaaaaaaatatatgaagagaaattaaaaaagaagaaaataaataataagtcaaattttctatttagtttaaataagtatgatatttttgaactagataatgaagaatttctatttataggtgtaaatcatgataaaactaatcggatagaatgtaattggataaatcaaaattataaaaattttgcagagttaaataatcttaaaaataagcagttacgaaaatcaattagtaaaaacatcatacagttcgagaaatttgcaacggatgtattaggaaatcgttataaagtaacaaatgaaaaattaatattttcgtatccaaaaaagtccatgagaggtgtacgatga

SEQ ID NO: 34 - DNA, 3930 bp, Kurthia huakuii
atgaattattcaattggtttagatattggaacaacaagtgtaggctgggcttgtatcaatgagcaacatgaaattttacgctatcaaaataaatgggcgataggtgtacgtgaatttgaagctgcgcaaacggcagaaactactagacaaaagcgccaaactcgacgtcgttataaccgtcgtaaaaaaagaattcagttagtgcaacagttattttcagcttatgtacctacagatttttttggagcaacagattcactccatttttggaaaaatgacaatcaatttgagcaacgtactttatcacaagtattaaaagaattacgtattaaccctaaaaaaattccaactatttatcatttgagaaaattactaatggaaggtccaaaacaagatattcgcttaatttatttggcgatacataatttaataaaatatagaggccattttctaaatactgggcgctggacgaagcaaaatcaagggtttaattttttagtagagtgcagcgacatagtaactgcctatagtgaaatcaatggtttagcattaccatctctcgactttcaggcaatacagtccatcattgaagataccgatatggtgcgcaaagataaacaaaaacaattagaaaaagtatcatcaaaatcatttgtgccattgtggcaactactattagggttaagtgtaaatgcagaaaaactgtttgttgaatcgcaaaatacaatactttataaagaagctaaattgaaattagttttaggaagtgaagaattagacgaggtgcgtgaaaatttaacagaagtagaaaatcattttattgatgaagcttttgcactatatcagcaaataatgctacaagatttgttgcaaggacatgaatgtgttgcagcatctaaagtggctagttatgaaaaatatcaagaagatttgtgtgaatttaaacgtcttataaatgaaactaaagatgaagcattatatcgtcgcttatttattacgcccaaaaaagcaatggcagaatataaggaacaaccgaataaagataataaagagaaattatgtttattagatcgttacaatcgtagttcaaaagataaagaagcggtactgaatactatggctaaactattagcaacatcaaatgtaaatcatcatgccgatttgattgaaaatataaaagaaggcacatttttagcacatcaaaaaggcacacataatgcggcaattccaaatcaaaatagtatttatgaaatcgaacaaattttaacgaatcagcaatcgtattatagttttatcaccgatgaatttattaataaagttatcgaaattgcttcattccgtattccatattacattggaccattggcaaagaataatcaaagtaaatttgcatggttagagcgtataaacaatgaagggcatattacaccagcaacatttgattcattagttaatgaatcgataactgctgagcaatttattaaacgcatgattaataagtgcacatatttacaggaagaagatgttttaccaaaacagtctttattgtatcaatattttgaagtgttaaatgaactaaatagtattcagattcgcccagctaatgcggcaagtcatacaaaatatcgtttaccaattgaagccaaaaaatgtgtgattgaatttggttttcgacaatacaaggtaatgacacataagcgtttaattcaagtattaaaagaacagcaatttgagtatttgattggtgaagattatgaagtatttggcactcaacaagaaggacgatttgcaagcagtttaaaatcgtatgttgaatttaaatcactatttaaaaatagtgcagtaccatttgatgaagtaatgattgagcaattgattgaatggttaacaatttttaatgaaaagaccattattaaaaagaaaataaaagaacagtatccaaaatttcctgatgtgatgattgagcgcgtacttaaaaagaattttgttggatggggaaatttaagtaagaaattattagatgaactgattttaaatgatggaaaaacagtgattgaaaaaatgtgtgattctactttaaattttagagaaatgttgacggtgaaaaactctaatttagaagaattaattaagaaaaacaatcgttcaaaacgtcaaacgaaaaaaattaaatataaagatgtacaagatttagcgggatctccagcattgaaacgaggtatttggcaggctattaaagtagtagaggaacttacggaaatttttggagaaccacagcatattatgctagaagtagcacgcgaagaaggtacaaagcaacgtacgcaaagtcgtctgatgaagtttaaagcagtagtagacggtttaggtaaggacgaaaaatctctaaaaaatgaattaaactcgtatttaaatgagccagaagcaaaatttaaagacaatcgattttatttatatttactgcaacaaggtaaatgtgcatatagtggaaagcctttggatgttcaacacttagcgcagtatgaaattgatcacatttatccgcaaaattttgtgaaggatgatagtttagataatctagtattagtagaaaaatcacgcaaccaacaaaaaggtggtttcaagatgcctttagaaattttaaatgctgcagaaggagcgcgtatgcgtggcatttggaaaagttggcttgataaaggattcatgaatgataagaaatttcatcgcttatgtaaggctgctttttcagagctggatcgtgaccaatttattgcacgccagttagttgaaacaagacaaattattaaaaatgtaggcgtgctgttagaagaacgttttagtgagacgaccgttcacttagtaaaagcgccgattgtttcgaaatttagaaaagctttagaactacctaaattacgtaacttaaataataaacatcatgcgatggatgcacttttaaatgcgttattaattaatcacgcaattcaacagtacggtgaaaatattttcgctttctcatttaaagacaaagagcgatcaagtaaattagcaaaagcagctcaacaaaaaaatggctttttcttatttaatagttttttatctgaacaaataaaagggcctcgctctcgtaaaactttatctgctatagcatacgtagaagaaatttattatgagttaccttggcaaacaacaaagaaaataggaaatagcgacgaaatgttttttgatgaaacattacactcacccaaaataaaaccagcgaaatatgaatcgaataaaactaacctaagtgttcatgatagtgtgaaaagttctgctgttattgtagtgaagttgatggaacaaacaaaaaaacaaattgtcgagaaaatagatttgattcagttgagtgtattagaagataagcagtggcagcatttatctaatgatgagaaagctttgaaattagcatctcgtaaatattctactaaaaaaattatagctgctacatggattatgaaactgtcaaaatatcaaaaatttatgtggaataatcagatgttttatttagcgtcgatgaaggagcgacatttagcaacacaatttatagtacctaaagagttattgatggcctatttgcaagccaatgaacaaacttcagtggcaaagttgcaaacaatttatgccacgattgccgaagagatgtttaaacagtatccaatttatagagaagggaatatgccaaagaaggtagcagaatttacaaaagatattcaaaattttgaacaaatgacaaaacaagtaacagaaatttttaaagcgacagcgaataatgccacgcgttcggacagtttaggtagtaggttatctaaagttatgaaagcggcagaaatcaaagtagtttatgagtcgattacaggattgaaagtaagaaaacctaaagaattatattaa

SEQ ID NO: 35 - DNA, 4128 bp, Streptococcus equinus
atggaaaaatcatattcaatcggactcgatatcggaacaaatagtgtgggctggagcgtaattactgatgattacaaagttccagctaaaaagatgaaagttttaggaaatacagataagaagtatatcaagaaaaacttactgggtgcactgttatttgatagcggtgaaactgctgaagcaacacgtttaaagcgtactgctagacgtcgctatacacgtcgtaaaaatcgtttacgttatctacaagaaatttttggtaaagaaatggcaaaagttgatgaaagtttctttcaacgtttagaagaatcttttttgacagatgatgataaaacctttgattctcatccaatttttggaaataaagccgaagaagatgcttatcatcaagagtttcctacaatttaccatttgagaaaacatcttgcggactcacctgaacaagctgatttgcgtttggtttatcttgctttagctcacatgattaaattccgtggacattttttgattgaagggcaattagacgctgagaatactgatgttcaaaagttattcaatgattttgttgaagtgtatgatagaacccttgatgacagccacttatcagaaattacggttgacgcttcaagtattctaacagaaaaatttagcaaatcacgtcgtttagagaatcttattaaacactatccgacagaaaagaagaataccttatttggaaatcttgttgctttagctctaggattacaaccaaactttaaaacaagttttaaactatctgaagatgctaaattgcaattttctaaagatacttatgaagaagatttagaagagttacttggaaaaattggtgatgagtatgcggacttatttacatcagctaaaaatctttatgatgctattttgttgtcaggaattttaacagtagctgataataccacaaaagctccactatcagcttcaatgattaagcgttacaatgaacatcaagtagatttaaaaaaattaaaagaatttatcaaaaataatgcttctgataagtatgatgaaattttcaatgataaagataagaatggttatgctggttacattgaaaatggagtcaaacaagacgaattctataaatatttaaaaacaacactttctaaaattgatggaagtgattatttccttgataaaattgaacgtgaagattttttgagaaaacaaagaacgtttgataatggctctattccacatcaaattcatttacaagaaatgcgtgctattttacgacgtcaaggtgagtattatccattcttaaaagaaaatcaagctaaaatcgaaaaaatattaacttttagaattccttactacgtaggtccattagcaagaaaaaatagccgttttgcttgggctaaataccattcagatgagccgattacgccatggaattttgatgaagtagtagataaagaaaaatcagctgaaaaattcattacacgaatgactttaaatgatttgtatcttcctgaagaaaaagttttaccaaaacacagtcatgtatatgaaacatttgcagtatacaatgaattgactaaaattaagtatgttaatgagcaaggtaagtcatttttctttgatgcaaatatgaagcaagaaatctttgatcacgtatttaaagaaaatcgaaaagttacgaaggctaaacttttaagctatcttaataatgagttcgaagagtttcgaatcaatgatttaattggtcttgacaaagatagtaaatcatttaatgctagccttggaacctatcatgatttgaaaaagattttagataaatctttcttagatgataagacaaatgaacaaatcattgaagatattgtgttgactttgaccttatttgaagatagagatatgattcatgaacgtcttcaaaaatatagtgatatctttacttcacagcagttgaagaaacttgagcgtcgccattatactggttggggacgtctatcttataaattgattaatggaattcgcaataaagaaaacaacaaaactattcttgatttcttgattgatgatgggcatgctaatcgtaactttatgcagttaattaacgatgattcattatcgtttaaaactattattcaagaagcacaagttataggtgacgttgacgatattgaagcagttgttcatgatttacctggaagtcctgctatcaaaaaaggtatcctacaaagtgtcaaaatcgttgatgagctagtcaaagtgatgggacacaatcctcaaaacattgtcatcgagatggcacgtgaaaatcaaataactggctatggaagaaataaatcaaatcaacgtttgaaacgactacaagattctctgaaagaatttggtagcgacattcttagtaagaagaaaccttcttatgttgatagtaaagttgaaaattctcatcttcaaaatgaccgtttgttcctatactatatccaaaatggtaaggatatgtacacaggagaagaacttgatattgatcatttaagtgattatgatattgaccatatcatccctcaagcttttattaaagataattcgattgataatcgagtcttgacaagttcagctaaaaaccgtggtaagtcagatgatgtgccaagtattgaaattgttcgtaatagaaaatcgtactggtataaattgtataaatcaggcctaatttctaaatgtaaatttgataatttaactaaagcagaacgtggtggattaactgaaactgataaagcaggatttattaaacgccaattagttgaaacacgtcaaattacaaaacatgtcgcacaaattttagatgcccgctttaatacaaaacgtgatgaaaatgataaggtgattcgtgatgtaaaagttattactttgaaatcaagtttagtttcgcaatttagaaaagaatttaagttctataaagttcgtgaaattaatgattatcaccacgctcacgatgcttatctcaacgcagtagttggaacagctttgcttaaaaaatatccaaaattagcaccagagtttgtttatggtgagtataaaaaatatgatgtccgtaaacttgttgccaaatcttctgataaccattctgaattaggtaaagcaactgcaaaatacttcttctattcaaacttgatgaacttctttaaaactgaagtcaaatatgcggatggtagagtatttgaacgaccagatattgaaacaaatgcagatggtgaagttgtctggaataagcaaagagattttgacattgttcgaaaagttctttcttatccacaagttaatattgtgaagaaggtagaagagcaaacagtaggacaaaatggtgggttatttgataataatattttagctaagccagaaaaagatgataagaaaaaattatttccaattaaaaattcactctctacaacttcatatggaggatatgctagagctacaatagcttattcaattttgattgttagtgaatctcgtgaaaggaaagaattaaaattgttaggtttacctcttcttgacaaagtgaaatatgagaaaaatcctactgcttatttaaatggtattggaatagtaaatataaaaaatatctttaaactttccaaatattgtttgttggaatttaaagagaaaagcattacttatcatagatatatggtaagtaatcaagaattaaaaagagctaatcaattatctttaacttgtaaggaaactgagttaatatacacgtatataaaaagtggggaagataacattcaattagatggtaacgaaaaagtaatattatccctttggaataaaatgattgcttttatggagcagacaaaattaattgataagaaattgtttgtatctttgaaagaattaaaagatgaagtaaatttaataaacattttagatattgcttctaaatcgattgactttacaaaaataagtgcagggcagaagaaaatagtgttgaatgattctttatctctcccaattaaaagatggcaatttaagagtgatgaaaaaatgctaaaacaattgaatgatgccaccctcatccaccaatctgtcactggtctttatgaaacacgtattgatttgagtaaattaggagaagagtaa

SEQ ID NO: 36 - DNA, 4047 bp, Streptococcus equi
atgaaaaaaccttatactattgctcttgatattggtactaatagtgtaggatgggttgttgtgacggatgattatagggttccaacaaagaaaatgaaggtactaggaaatacagagcgaaaaaccattaagaaaaatttgattggtgccttattatttgatagtggtgatactgcagagggaactcgcttaaaaagaacggcccgtcgcagatatacaagaagaaagaatagactacgttaccttaaagaaatttttactgaggaaatggcaaaagtagatgatggtttctttcaacgactggaggattcattctatgttttagaggataaggagggaaataagcatccgatttttgctaatctagcagatgaagttgcttatcataaaaagtatccaacaatttatcatttacgaaaagagttagtagataatcctcaaaaagcagatttacgcttaatttatttggcagtagcgcatattattaagtttaggggacattttctgattgagggaacattaagttcaaagaataataatcttcagaaatcatttgatcatcttgtggatacctataatctattgtttgaggagcaacgattgcttactgaaggcattaatgccaaagagctgttgtctgcagcattaagtaagtcaaagcgtttagaaaatctcatttctctgattcctggacaaaagaaaacgggtatttttggtaatattattgcactctcgctaggattaacaccaaattttaaagctaattttggtttaagtaaggatgtcaaattacagttggctaaggatacctatgctgatgatttggatagtctactggctcaaattggagatcagtatgctgatttattcttagcggctaaaaatttatcagatgccattcttttgtcagatattttgacagaaagtgacgagataactagagcacctctgtcagcgtctatggtaaaacgttatcgtgagcatcacaaggacttggtcactttgaaaacattaataaaggatcagttaccggagaagtaccaggaaatttttttagataagactaaaaatggttatgctggatatattgagggacaagttagccaggaggaattttacaaataccttaagcctattttagcaagattggatggatcggaaccgttacttctaaaaattgaccgagaagactttttgagaaagcaacgaacctttgataatggctctattcctcaccaaattcatttagaagaattacacgctattttgagaagacaagaagtcttctacccatttttaaaagataatagaaagaaaattgaatctcttttaacgtttagaataccttattatgtgggtccgttggctcgtggtcatagtcgctttgcatgggtaaagcgaaaattcgatggggctattagaccctggaattttgaagagattgttgatgaagaagcttccgcacagatctttattgaaaaaatgactaaaaatgatctctacttgccaaatgaaaaggttcttcctaagcatagcctattatatgaaacttttacagtttataatgagctaacaaaggtcaaatatgctactgaaggaatgacacgtcctcaatttttatctgctgatcagaaacaagctattgttgacttattgtttaaaacaaatcgtaaagtgactgttaaacaattaaaagagaactattttaaaaagattgagtgctgggatagtgttgagattactggggttgaagatagcttcaatgcttcacttgggacctatcatgacttgttaaaaatcattcaggataaggattttttagataatcctgacaaccagaaaatcattgaagatattattttgaccttaacactttttgaagataaaaaaatgatttcaaaacgattagatcaatatgcacatctctttgataaagtcgtattgaataaactggagaggcatcactataccggttgggggcgtttatcaggaaagcttataaatggtattcgagacaaacaatcaggaaaaacaattttagattttctaaaggctgatggttttgccaatcgaaactttatgcagttaattcatgatagtgaactaagctttatagatgagattgctaaagcccaagtgattggaaaaactgagtattcgaaagacctggttgggaatttagcgggtagtccggctattaaaaaaggtatttcacaaacaattaaaatcgttgatgagctggtcaaaatcatgggctatctcccgcagcagattgttattgaaatggcacgtgaaaatcagactacagctcaaggaattaaaaatgctcgtcaacgcatgagaaagctagaagagactgccaaaaaattgggtagcaatattctgaaggagcaccctgttgataatagtcaattgcaaaatgataagcgttacctctattatcttcaaaatggaaaggatatgtatacgggtgatgacttagatattgattatttgagtagctatgacattgatcatatcattccgcagagctttattaagaataattccattgataacaaggtattaacctcacaaggcgctaatcgaggaaaattagataatgttcctagtgaggctattgttaggaaaatgaaaggctattggcaatccttattgagagcaggagctatctcaaagcaaaaattcgataatctgacaaaagcagaacgtggaggtttaactcaagtagacaaagccggctttatccaacgtcaattagtggagacacgccaaatcacaaaacatgtggcacaaatcttagatagtcgcttcaatactgaatttgatgatcataataagcgtattcgaaaggttcatattataacgctaaaatcaaagctggtttctgatttccgtaaagagtttggtttgtataaaattcgtgatatcaatcattatcatcatgctcatgatgcataccttaatgctgttgttgccaaagcgatactaggtaagtatcctcaactagctccagaatttgtttatggagattaccccaaatataatagctttaaggaacgccagaaagcaactcaaaagatgttattttattcaaatatcttaaaattctttaaagaccaagaaagtcttcatgttaactctgatggtgaagaaatatggaatgccaataagcatttacctattattaaaaatgttctttcgattccgcaggttaatatcgtcaagaaaacggaagtacaaacagggggcttctataaagagtccattttgtctaagggtaattctgataagctgatcccaaggaaaaataactgggataccaggaagtatggtggctttgatagtccaactgtagcttattctgttttggtgatagctaaaatggaaaagggaaaagcaaaagtattaaagccagtgaaggaaatggttggtattaccattatggagaggaccgcatttgaagaaaatcctgtagtctttttagaagcaagaggctatcgagaaattcaagagcatctcattataaaactccctaaatatagcttgtttgaattagaaaatggaagaagacgtttattggcaagtgctagtgaactacaaaaaggaaatgaattgtttcttccagttgattatatgacatttctatatttagctgctcattaccatgagctaactggatcctcagaggatgttttgaggaaaaaatattttgtagataggcatttgcattattttgatgacattattcaaatgattaatgattttgcagagcgtcatattcttgctagtagtaatttagagaaaataaaccatacatatcacaataattctgaccttccagttaatgaaagagcagagaatatcattaatgtgtttactttcgtagccctaggagcacctgcagcctttaaattttttgatgcgactattgatcgaaaacgatatacctcaactaaggaagtgctaaatgccactctcattcatcaatctgttactggtttgtatgagacgcgaattgatttgagtcaattaggagagaactaa

SEQ ID NO: 37 - DNA, 4023 bp, Enterococcus faecium
atgaagaaagagtatacgatcggattagatatcgggaccaattccgtcgggtggtccgtattgacagatgactatcgactggtttccaaaaagatgaaagtagcaggaaatacagaaaagagtagcacgaagaaaaacttttggggtgttcgactttttgacgaaggccagactgccgaagcaagaagaagcaagcggaccgcgcgcaggaggttagcgagacgcagacaacgaatccttgaactgcagaaaatattcgcaccagagatcttaaaaatagacgaacacttttttgctcgactgaatgaaagttttttagtcctagatgaaaagaaacagtcgagacatccggtctttgctacgatcaagcaagaaaaaagctaccatcagacttacccgacgatctatcatttgagacaagcgctagctgactcttcagagaaagcggacatccgtctcgtttatttagcgatggctcatctcttgaaatatcggggacattttttgattgagggtgaattaaatacggagaattcctcagtgacagagacttttcgtcaatttctgagcacatataaccagcaattcagcgaagcagacgacaaacaaacagaaaaattagacgaagcggtcgattgttctttcgtttttacagaaaagatgtcgaaaacaaaaaaagcagaaacgctcctgaaatattttcctcatgaaaaatccaatggttatctcagtcaatttataaaattaatggtagggaatcaggggaatttcaaaaatgtatttggattagaagaagaagcaaaactgcaattttcaaaagaaacatatgaagaagaccttgaagaattgttagagaaaatcggagatgattacatcgatctttttgtccaagcgaaaaatgtttatgatgctgtcttgttatctgagattctttctgacagcacgaaaaatacacgagcgaagctttcagcagggatgatcagacgctatgacgcacataaagaagacttggtccttctgaaacgatttgtgaaagagaatctgccgaagaaatatcgcgccttttttggggataattcagtcaacggatatgcagggtatatcgaagggcatgcgacacaagaagatttctataaatttgtcaaaaaagaactgacaggtatccgaggcagcgaggtgttcctgacaaagatcgaacaagagaattttttgagaaaacagcgcacatttgataacggtgtgatcccgcatcagatccatttgaccgagctgagagcaattattgcaaaccagaaaaagcattatccttttttaaaagaagaacaagaaaagctggaaagtttattgaccttcaagataccgtattatgttggtccgttagcaaaaaaacaggaaaatagtccatttgcgtggcttatcagaaaatcagaggaaaagatcaaaccttggaacttacctgaaatagtggatatggagggctctgctgtccggtttatcgaacgaatgatcaacacagatatgtacataccacacaacaaggtattgccaaaaaacagcctgttgtatcagaaattttcgatctataatgagttgactaaagtaagatatcaagacgaacgtggtcagatgaactatttttccagcatagagaagaaagaaatctttcatgaattgttcgaaaagaatcgaaaggtaaccaaaaaagatttacaagaattcttgtatttgaaatacgatatcaaacacgcggaactgtccggcatcgaaaaagcattcaacgcttcctatacaacgtaccacgattttttgaccatgagtgaaaataaaagagaaatgaaacaatggctggaagatcctgaattggcatcaatgtttgaagaaatcatcaaaacgctgactgtttttgaggatcgggaaatgattaaaacaaggctgagtcatcatgaagcgactttaggtaaacacataatcaagaaacttacaaaaaaacattacactggttggggtagattatcgaaagaactgattcaaggaatccgagacaaacaatcgaacaaaacaatcttagactatttgatcaatgatgacgattttcctcatcatcgaaatcgtaacttcatgcagctgatcaatgatgatagtttatcgttcaaaaaagaaatcaaaaaagcacaaatgatcacagacacagaaaatctggaagaaattgtcaaagaattaacaggcagtccggctatcaaaaaaggtatcctccaaagtttgaagattgtagatgaaatcgttggcatcatgggctatgaaccagcaaacatcgtggtcgagatggccagagaaaatcaaacgacgggcagaggactcaaaagttcacggccgcggttgaaagctttggaagaatcacttaaagatttcggcagtcaattgctgaaagagtatccgaccgataacagctccctgcaaaaagaccgattatatctctattatttgcagaatggtcgagacatgtatacaggtgcgcctttagatatccatcgattatcagattacgatatcgaccatattatcccaagaagttttacgaccgataactcaatcgataacaaagttttagtttcctcaaaagaaaatcgtctgaaaaaagacgatgtaccaagtgagaaagtcgtgaaaaaaatgcgcagtttctggtacgacctttattcgtctaagctgatcagtaaaagaaaacttgataatctgacaaaaatcaaattgacggaagaagacaaggcaggattcatcaaacggcagttggtggaaacgcgtcagattaccaaacacgtagccggtattttacatcatcggttcaataaagcagaagacacaaatgaaccgatacgtaaagttcggatcatcacgctcaaatctgcactagtcagtcaattcagaaaccgtttcgggatctataaagtacgtgagattaatgaatatcatcacgcacatgatgcatatctgaacggtgtggtcgctcttgctcttttgaagaaatatccgcaactagcaccggaattcgtttatggcgaatatctgaagttcaatgcgcataaagcaaacaaagcgacggtaaaaaaagaattttattcgaacatcatgaaatttttcgaaagtgacacaccggtttgcgatgaaaatggcgagattttctgggacaaatcaaaaagtatcgcacaggtaaaaaaagtcatcaatcaccaccatatgaatatcgtgaaaaaaacagaaattcaaaaaggaggcttctcaaaggaaacagttgagcctaaaaaagattcttctaagctgttacctcggaaaaacaactgggatccagctaaatacggcgggttaggtagcccaaacgttgcttacacagtcgctttcacttatgaaaaaggaaaagcgcgcaaacggacaaatgcgctagaaggcatcacaatcatggagagagaagcatttgaacaatcccccgttttatttttgaaaaacaaagggtacgaacaggcagaaattgagatgaaattgcctaagtacgcgctatttgaactagaaaacgggcgtaaacgaatggtcgcaagcaataaggaagcacaaaaagccaattcatttctcttgccggagcatctagtcacacttctttatcatgcaaaacagtacgatgagatttctcataaagaaagttttgattatgtgaatgaacaccacaaggagttttcagaagtgtttgcccgtgtcctcgaatttgcagggaaatataccttggcagagaaaaatattgagaaactggaaaaaatttacaaagaaaaccaaacggatgatctagctaaactagcaagttcttttgtcaatctcatgcagttcaatgcgatgggcgcaccggctgatttcaaattttttgatgtgacgatcccgcgaaaaaggtacactagcttgactgaaatctggcagtcaacgattattcatcaatcaatcaccggattatatgaaactcgtatcaggatggggaaataa

SEQ ID NO: 38 - DNA, 3993 bp, Enterococcus italicus
atgaaaaatgattacacgattggattggatatcggtacgaactctgttggctattctgttgtgacggatgattacaaagtgatttcaaaaaaaatgaacgtatttgggaatacggaaaagaaatcaatcaaaaaaaatttttggggtgtgcgattatttgaaagcggccaaacagcacaagaagccagaatgaaacgaacctcgcgtcgaagaattgcgagaagaaaaaatagaatttgctatcttcaagaaatatttcaaccagagatgaatcatttggacaataatttcttttatcggctaaatgaaagttttcttgttgcagacgatgctaaatatgataaacacccgatttttggtactttggatgaggaaatccactttcatgagcagttccctactatttatcatttgagaaaatacttagctgacggtgatgaaaaagctgatctaagactcgtttacttggctattgcgcatattattaagtttagagggaactttttaattgaaggtgaattgaatactgagaacaactcagttatcgagctttccaaagtttttgttcagctatacaatcagacattaagcgagttagaagggtttcaattcattgatgagtccatcgatttttctgaagtattaacccagcagttaagtaagtctgaacgagctgataatgttcttaaactttttccagatgaaaaaggaacaggaatcttcgcgcaatttatcaagttgattgtaggaaatcaaggtaacttcaagaaagttttccaacttgaagaagatcaaaagttgcagctatcaacggatgattatgaagaaaacattgagaatttattagcaataattggtgatgaatacggcgatatatttgtagcagcacaaaatttgtatcaagcaatcttattagctggaattttaacttcaacggagaaaacaagggcaaagttgtcagcttcgatgatccaaagatatgaagagcatgccaaagatttaaagttattaaaaaggtttgtaaaagagcatattccagataagtatgctgagatttttaatgatgcgacaaaaaatggatacgccggatacattgatggaaagacgaaagaggaagaattttataaatacttgaaaaccactttggttcagaagagcgggtaccagtattttattgagaaaatagaacaagaaaactttttacggaagcaaagaatatatgataatggtgttatcccgcatcaagtccatgcagaagaattacgtgcaatactgagaaaacaagaaaaatactattcatttttgaaagaaaatcatgaaaaaatagaacaaatatttaaagtaagaattccttactatgttggtccattggcgaaacacaatgagcaaagtaggtttgcttggaatataagaaaatcggatgaaccaattcgaccttggaatatgaatgatgttgtcgatgagaatgcttcagcagtagcctttattgaaagaatgacgataaaagatatttatcttaacgaaaatgttttgcctagacatagcttaatctatgaaaagtttacagtctttaatgaactgacaaaagtattgtatgcggatgatagaggtgttttccaacgattttcagccgaagaaaaagaagatatctttgaaaaactatttaaaagtgaaaggaaagtaacaaagaaaaaattagaaaactatttacgtatcgaactatcaatatcaagcccatcagtaaaaggaattgaagagcaatttaatgccaattttgggacatatttagatttgaaaaaatttgatgaactgcatccctatttagatgacgaaaaatatcaagatactttggaagaagtaataaaagtattaactgtctttgaagatcgctcgatgattcaaaatcaacttgaacaattaccactgaatttatcgacaaaaacgataaaagcattgagccgcagaaaatatactgggtggggcagattgtcagctagactaattgatggaattcacgacaaaaattctggcaagacgattttggattatttaattgaagatgaatctgattcgtatatagtaaatcgtaatttcatgcaattaattaacgatgatcacctatcttttaagaaaataattgaagacagccaaccgtataaagaacagcaatctgctgaagagattgtttccgaattgagtggaagtccagcaataaaaaaaggaatcttacagagcttaaaaatagtagatgagcttgttgctatcatgggttacaagcctaaaaacatcgtggtagagatggccagagaaaaccaaacaacaggtcgtggaaaacaaaattccaagccaagattgaaaggtattgaaaatggattgaaagaattctctgacagtgttttaaaggggagttcgattgataacaagcagcttcaaaatgacagactttacttgtactatcttcaaaatggaaaagatatgtacactggacatgaattagatatcgatcacctatcgacctacgatatcgaccatattatcccacaaagtttcttaacagataattctattgataatcgagtattgactacttctaagtcaaacagagggaaatctgacaatgtgccaagtgaagaagtggtcagaaaaatggatcgcttttggagaaagttgctaaatgcaaaacttataagtgagcgtaagtatacaaatctaactaaaaaagaactaacggaaagtgataaagcaggatttttgaaaagacagttagttgaaactagacaaattacgaaacacgtagcgacaattttagattcgaaatttaacgaagatagtaataatcgagatgttcagataattacattgaaatcggctcttgtttcagaatttagaaagactttcaatctttataaagtgcgcgaaataaacgatctacatcacgctcatgatgcgtatttgaatgcagtagtagctctatctttgttgagagtgtacccacagttgaagccagaatttgtttatggagagtatggtaaaaattccatacatgatcaaaataaggcgactataaaaaaacaattttatagcaatatcacaagatattttgctagcaaagactatattatcaatgatgatggagaaattttatggaataagcaagaaacaatagcacaagtgattaagacactaggtatgcatcaagtaaacgtcgtgaagaaagttgaaattcaaaaaggtgggttctctaaagaatcgatacaaccaaaaggtgaatctcaaaaactgattagaagaaagcagcaatggaatacaaaaaaatatggtggatttgatagcccagtagttgcctatgctattttacttagttttgataaagggaaaaggaaagctagatcatttaaaatagttggcataacaattcaagatagagaaagttttgagggaaatccaattctctatttatcaaaaaaagattaccataatccaaaagttgaggctattttacctaaatattctttatttgaatttgaaaatggccgtagaagaatggtggcaagtgcttctgaaactcaaaaaggaaaccagttgatcattccaggacatttaatggagttattgtaccattcgaaaaaaattattaatggtaaaaatagcgatagcgtgagttacattcaaaataacaaagagaaatttagagaaatttttgaatatattgtagatttctcaagcaaatatatttcagcagatgcaaatctaaataaaatagaaaaaatatttgaaaataattttcacaaggcaagtgaacaagaaatagcaaaatcgtttattaacttattaacatttactgctatgggagctcctgcagattttgaattttttggtgagaagatacctagaaaacgatatgtctccataagtgaaataatagatgcggtttttattcaccaatcgattactggactatatgagacaagggtacgtctaacggaggtctaa

SEQ ID NO: 39 - DNA, 4155 bp, Streptococcus agalactiae
atgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagagggagcaagtatcctatctttgcaacattgcaggaagagaaagattatcatgaaaaattttcgacaatctatcatttgagaaaagaattagctgacaagaaagaaaaagcagaccttcgtcttatttatattgctctagctcatatcattaaatttagagggcatttcctaattgaggatgatagctttgatgtcaggaatacagacatttcaaaacaatatcaagattttttagaaatctttaatacaacttttgaaaataatgatttgttatctcaaaacgttgacgtagaggcaatactaacagataagattagcaagtctgcgaagaaagatcgtattttagcgcagtatcctaaccaaaaatctactggcatttttgcagaatttttgaaattgattgtcggaaatcaagctgacttcaagaaatatttcaatttggaggataaaacgccgcttcaattcgctaaggatagctacgatgaagatttagaaaatcttcttggacagattggtgatgaatttgcagacttattctcagcagcgaaaaagttatatgatagtgtccttttgtctggcattcttacagtaatcgacctcagtaccaaggcgccactttcagcttctatgattcagcgttatgatgaacatagagaggacttgaaacagttaaaacaattcgtaaaagcttcattgccggaaaaatatcaagaaatatttgctgattcatcaaaagatggctacgctggttatattgaaggtaaaactaatcaagaagctttttataaatacctgtcaaaattgttgaccaagcaagaagatagcgagaattttcttgaaaaaatcaagaatgaagatttcttgagaaaacaaaggacctttgataatggctcaattccacaccaagtccatttgacagagctgaaagctattatccgccgtcaatcagaatactatcccttcttgaaagagaatcaagataggattgaaaaaatccttacctttagaattccttattatatcgggccactagcacgtgagaagagtgattttgcatggatgactcgcaaaacagatgacagtattcgaccttggaattttgaagacttggttgataaagaaaaatctgcggaagcttttatccatcgtatgaccaacaatgatttttatcttcctgaagaaaaagttttaccaaagcatagtcttatttatgaaaaatttacggtctataatgagttgactaaggttagatataaaaatgagcaaggtgagacttatttttttgatagcaatattaaacaagaaatctttgatggagtattcaaggaacatcgtaaggtatccaagaagaagttgctagattttctggctaaagaatatgaggagtttaggatagtagatgttattggtctagataaagaaaataaagctttcaacgcctcattgggaacttaccacgatctcgaaaaaatactagacaaagattttctagataatccagataatgagtctattctggaagatatcgtccaaactctaacattatttgaagacagagaaatgattaagaagcgtcttgaaaactataaagatctttttacagagtcacaactaaaaaaactctatcgtcgtcactatactggctggggacgattgtctgctaagttaatcaatggtattcgagataaagagagtcaaaaaacaatcttggactatcttattgatgatggtagatctaatcgcaactttatgcagttgataaatgatgatggtagatctaatcgcaactttatgcagttgataaatgatgatggtctatctttcaaatcaattatcagtaaggcacaggctggtagtcattcagataatctaaaagaagttgtaggtgagcttgcaggtagccctgctattaaaaagggaattctacaaagtttgaaaattgttgatgagcttgttaaagtcatgggatacgaacctgaacaaattgtggttgagatggcgcgtgagaatcaaacaacaaatcaaggtcgtcgtaactctcgacaacgctataaacttcttgatgatggcgttaagaatctagctagtgacttgaatggcaatattttgaaagaatatcctacggataatcaagcgttgcaaaatgaaagacttttcctttactacttacaaaacggaagagatatgtatacaggggaagctctagatattgacaatttaagtcaatatgatattgaccacattattcctcaagctttcataaaagatgattctattgataatcgtgttttggtatcatctgctaaaaatcgtggaaagtcagatgatgttcctagccttgaaattgtaaaagattgtaaagttttctggaaaaaattacttgatgctaagttaatgagtcagcgtaagtatgataatttgactaaggcagagcgcggaggcctaacttccgatgataaggcaagatttatccaacgtcagttggttgagacacgacaaattaccaagcatgttgcccgtatcttggatgaacgctttaataatgagcttgatagtaaaggtagaaggatccgcaaagttaaaattgtaaccttgaagtcaaatttggtttcaaatttccgaaaagaatttggattctataaaattcgtgaagttaacaattatcaccatgcacatgatgcctatcttaatgcagtagttgctaaagctattctaaccaaatatcctcagttagagccagaatttgtctacggcgactatccaaaatataatagttacaaaacgcgtaaatccgctacagaaaagctatttttctattcaaatattatgaacttctttaaaactaaggtaactttagcggatggaaccgttgttgtaaaagatgatattgaagttaataatgatacgggtgaaattgtttgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaagggtaaagcacaaaaactaaaaacagttacggaacttttaggaattaccatcatggagaggtccagatttgagaaaaatccatcagctttccttgaatcaaaaggctatttaaatattagggctgataaactaattattttgcccaagtatagtctgttcgaattagaaaatgggcgtcgtcgattacttgctagtgctggtgaattacaaaaaggtaatgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaagataataaggaaaatatatcagtagatgaacttgctaataatattatcaatctatttacttttaccagtctaggagctccagcagcttttaaattttttgataaaatagttgatagaaaacgctatacatcaactaaagaagtacttaattctaccctaattcatcaatctattactggactttatgaaacacgtattgatttgggtaagttaggagaagattga

SEQ ID NO: 40 - DNA, 4113 bp, Streptococcus ratti
atgaaaaagccttactctattggacttgatattggtaccaactctgtcggctgggctgtcataacagatgactacaaagttcctgccaagaagatgaaagttctgggaaatacagacaaaaattacattaagaaaaatttattgggagctttattgtttgatagtggaaatactgcggaagatagacgcttgaaacgtacagcacgccgtcgttatacacgtcggcgaaatcgtttgctgtatttgcaagatattttttcagatgaaatgaataaggttgatgagagttttttccatcgtttagaagattcttttcttgtttctgaagataagcgaggagaccaccatcctatttttggaaatgttgtggatgaagtgaaatatcatgaacagtttcctaccatttatcatttacgaaaatatcttgcagatactccagaaaaagctgatttacgtttggtttatttggctttggcacatatgattaagtttagaggccattttttaattgatgatccgaaattggatgtaaaaaatactgatagtcaggaattgttcagccagtttttaacggcttatgatgtgacacaggaagatagtcatctggcagatgtaaagatcaatatctctgatattattactgaaaaaatgaataagtctcgtaaagtagaagctctattatttcatttcccaagtcaaaagaaaaattcattttttggaaacctcgtgtcacttgtttttggattactccctaattttaagacgaattttaatttagctgaagatgctaagctacagttatctaaggattcttatgatgaagatttggagaatttattaggacaaattggtgatgaatatacagatgtctttgtagctgctcgaaagctgtacgacagcattttgttatcaggaatcttgacggttaatgatttgagtacaaaagcgatcttatctgcttctatggttagacgttatgaagagcataataaggatttagctaaactaaaagcctttgtcaaagcgaattttacacatgatgtatttaaagaagtcttttctgatgcaagtaagaatggctatgcgggttatattgaaggtaaaaccagccaggaagacttttataaatacgtgaaaaatctaattggtaaagtagatggcagtgcagactttattgaaaaaatcgatcgtgaggattttctaagaaagcaacgtacctttgataatggttcaattcctcatcaggtacatttagctgagatgaaggctatcttaagacgtcaaggtgaatactatccgttcctaaaagaacatgctgaaaaaattcaacaaattttgacctttagaatcccttactatgtcggtcctttggatcgtcatggtcatagtgattttgcttgggcaagctttaattcggaagaaaaagtgacaccttggaattttgaagagattattgataaaaacaaatcagctcaggcttttattgaacgtatgactaatcaagatttgtatttgccaaacgagaaagtgctaccaaagcatagtcccttgtacgaaaaatataccgtctataatgaattgactaaaattaaatatgttactgaaacaggcacagctaaattctttgatgcgaatttgaaacaagaaatttttgatggtcttttcaagaaagaacgaaaagttactaagagaaaactgttaacgttcttagagaagaattttgatgagtttagaattgttgatatccaaggcttggataaggaaactgaaacatttaatgcctcttatggtatctatcaggatctattaaagattattaaagataaagcgtttatggacgattctgaaaacgctgatattcttgaagatattgttcttacattaacactcttcgaagacagagaaatgattaagcaacgattggcaaaatatgcggacttgtttgataaaaaagtgattgataatcttgcacgccgtcgctacacgggctgggggcgtttgtcagcgaaattactcaacggaattcgagataaacgatcacgtaagacaatcatggattatttagttgatgatggtcgttcaaatcgtaatttgatgcagctaattacggatgataacttaacgtttaaagatgagattgcgaaggctcagtatagtgataatagcgatgatttgcatcaagttgttcaagatttagcaggcagtcctgctattaaaaaaggcattttacaaagtgttaagattgttgatgaactggtgaaagtcatgggatacgaaccagaacaaattgttgttgaaatggcacgtgaaaatcaaacgacggccaaggggcgtcgcaattcacaacaacgttataaacgacttgaggaggcaataaaaaatcttgaccgcgatttaaattataaaattttaaaagaacatccaacagataaccaagctttgcagaatgatcgtcttttcctgtattatctccaaaatggccgagatatgtatactggtgagtcattagatattaatcgtttaagtgactatgatattgaccatattattccgcaggcctttattaaggataattcgattgataatcgtgttctagtctcgtcagctaaaaatcgtgggaagtcagatgatgtaccaagtgaagatgttgtcaataggatgagaccgttttggaataaattgttgaactgtgggctgatttctcaacggaaatacagtaatttaaccaaaaaagaattaacaccaaatgataaggctggctttatcaagcgtcaattagttgaaacacgtcaaattactaaacatgtagcacgtattcttgatgaacattttaataaagaatttgatgaagataagaaacggattcgtaaggtcaaagtagtcactctaaaatccaatctggtatctaacttccgtaaggagtttgaactctataaagtgcgtgaaattaatgattaccatcatgcgcatgatgcttatcttaatgcagttgtggctaaggctctcctaatgaaatatcctaaactggaaccggaatttgtgtatggcgagtatccaaaatataatagctaccgagaacgtaaaacggcaactcaaaggatgtttttctattctaatatcatgaatatgttcaaatccaaagtcaaactagcagatgagcgaattattgaacgtccgatgattgaagtgaatgatgaaacaggagaaattgcctgggataaaacaaagcatatcgctactgtcaaaaaagttctctcctatccacaaatcaatattgtgaagaaggtagaggaacagacaggtggattaacaaatgaaacgatatatccgcgtggtagttttgataaattattgaatcggaaaaatactttagaagctagtaagtatggaggatttggcagtccaacagtagcttattgcgttttagtagttgcagatagtaaaaatgagaatggcaaggtaaagaaattaaaattaggttctgaattgcttggtattacaattcttgaaaaaaatgattttgaaaataattccttagattttttaagtagaaaaggatatcaaggagttcaagagaaaaagataatcaagttacctaaatatagcctatttgagttccaagacggtagtaggagaatgctatcaagtgttatggctaatgataacaaacgtggagatctgcaaaaagcaaatgaaatgattttgccagcttatcttgtgaaattgctttatcatgctaaacatataaatagcgttggagagccagctcataaaaactatataaacgagcattgctctgagtttcaagatttattgaattatattaggcagtttgcggataagtttgttgatgtagataaaaatttaagtaaaataagatctctttctaaatctatggcagagtattccgtgagtgaaatctgtagttctttcgttaatttattaacattaacagcattgggtgcaccagcagactttaagttttttgggacaacaataccgaggaagcgatatgggtcacctcagtccattctctctgccaccctcatccaccaatccatcactggtctttacgaaacgcggattgatcttagtaaattaggagaagactga

SEQ ID NO: 41 - DNA, 4038 bp, Listeria monocytogenes
atgcaactaaaaattattgaagggatgaaaaaaatgaaaaaaccgtacacgattggactagacataggaacaaactcggttggatgggcagtgttaacagatcaatatgatttagtgaagaggaaaatgaaaattgctggagactctgagaaaaaacagataaagaaaaatttctggggagttagactatttgatgagggtcaaacggcagctgatagaagaatgactagaacagctagaaggagaatagagagaagacgcaatcgtatttcgtatttacaagggatatttgcggaagaaatgtctaaggtggatgcaaatttcttttgccgattaagtgatagcttttatgttgataacgaaaaaagaaatagtcgtcatcctttttttgcgactatagaggaagaagtagaataccacaaaaactacccaaccatttatcacctgagagaagaactcgttaattcttcagaaaaagctgatttaagattagtttatttagctttagctcatattataaaatatcgagggaactttttaattgagggagcattagatacccaaaatacttctgttgatggaatatataagcaatttatacaaacatataatcaagtgtttgcaagtggcattgaagacggttcgctaaaaaaattggaagataataaggacgtagctaaaattctcgttgaaaaagttacgcgaaaagaaaaacttgagagaattttaaaattataccctggtgaaaaatctgccggaatgtttgctcagtttatcagcttgattgtaggcagtaaagggaattttcaaaagccttttgatcttattgagaaatcggatattgaatgtgcgaaagatagctatgaagaagatttagagtctttgttagcgctaattggagatgaatatgcggaactttttgttgcagcgaaaaatgcatatagtgctgtggtgttatctagtattatcacagtggctgaggctgaaacaaacgcgaagttatccgcaagtatgattgaacgttttgatacacatgaagaagatttaggggaattgaaagcatttatcaagctccatcttcctaaacactatgaagaaatatttagtaataccgaaaaacatggttacgcaggttatatagacggtaaaacaaagcaggcagacttctataaatacatgaaaacaacattagagaacattgaaggcgccgattattttattgctaaaatagaaaaagaaaactttttacgaaaacaacgaacctttgataatggggctatcccgcatcaattacatttagaagaattagaagctattttacaccagcaagcaaaatattatccttttttaaaagaaaactatgataaaatcaaaagtttagtaacttttagaattccatattttgttggtccgctagctaacggacagagcgaattcgcatggttaacaagaaaagctgatggtgagattagaccgtggaatatagaagagaaagtggatttcggtaagtcagcggtcgatttcattgaaaagatgaccaataaagatacatatttacctaaagaaaatgtattgcctaaacacagtctctgttatcaaaaatatttggtttataatgagttaaccaaagttagatacattaatgaccaagggaagactagctatttttctgggcaggaaaaagaacagatttttaatgacttatttaagcaaaagcgtaaagttaaaaagaaggatttagagctgttcttacgcaatatgagccatgttgaaagtccaactattgaaggcctggaagactcgtttaattcaagttattctacctatcatgatttactcaaggtagggataaaacaagaaatccttgataacccagtaaatacggaaatgctagaaaatatagtcaaaattttaactgtgtttgaagataaacgtatgattaaagagcagttacagcaattttctgatgttttagatggggttgttttgaaaaaattagaacgacgacattatacaggatggggaaggttatcagctaagttattaatgggaattcgtgataagcaatctcacttaactattttagattatttgatgaatgatgatggacttaatcgtaatctgatgcaacttataaatgacagtaatttatcatttaaatcaataattgaaaaagaacaagtaactacagcagataaagatattcaaagtattgtggcagaccttgctggtagcccggctataaaaaaaggtattctacaaagcttgaaaattgtcgatgaacttgttagtgtaatgggctacccacctcaaactattgttgtggaaatggcaagagaaaatcaaacaacaggaaaaggaaaaaataattctagaccacgttataaatcattagaaaaagcgattaaagaatttggtagtcaaattctaaaagagcatccgactgataatcaagaattaaaaaataatagattgtatttgtattatttacagaatgggaaggatatgtatactggacaagagttagatattcataatctttctaactatgatattgatcatattgtgccacagagttttataacagataactccattgataatcttgtgttaacgagttcagctgggaatcgggaaaaaggggatgatgttccaccactagagatcgttcggaagagaaaagtattctgggagaagttataccaagggaatttgatgagtaaacgtaaatttgattatttaactaaagctgaacgtggtgggcttacagaaacggataaagcgagatttatccatcggcaattagtggaaactcgtcaaataacgaagaatgtagctaatattttacatcaacgttttaattatgaaaaagacgatcatggcaatactatgaagcaagttcgaattgtaacattaaaatctgcgctggttagccaattccgtaagcaatttcaattgtacaaggtgcgagatattaatgattatcatcacgcccatgatgcttacttaaatggggtagtcgcgaatacgttattaaaagtatatcctcaattagagccggaatttgtttacggcgattaccatcaatttgattggtttaaagcgaataaagccacggcgaaaaaacaattctatacaaacatcatgttattctttgcacaaaaagatcgaataatagatgaaaacggtgaaattctttgggataaaaaatatttagatactgtcaaaaaagtcatgagttatcgacaaatgaatattgttaagaaaacagaaattcaaaaaggagaattttcaaaagctacaattaagcccaaaggaaattccagtaaattaattcctagaaaaactaattgggacccgatgaaatatggtggtcttgatagccctaatatggcatatgcagtggttattgaatatgcaaaagggaaaaataaattagttttcgagaaaaaaattatccgtgttactatcatggaacgtaaagcatttgaaaaagatgagaaagcctttttagaagaacaaggttatcgtcagcctaaagtcctcgcgaaattaccgaaatatacgttatatgaatgtgaggaaggacgtcggagaatgctggctagtgctaatgaagctcagaaaggaaatcagcaggtattgccaaaccacctggtaacattactacaccatgcggcaaattgtgaggcaagtgatgggaaaagccttgattatattgaaagtaatagagaaatgtttgctgaactactagcgcacgtatcagaatttgccaaaagatatacgttagctgaagctaatctaaacaaaattaatcagctttttgagcaaaataaagaaggtgacatcaaggcaattgcacgatcttttgttgatttaatggcattcaatgcgatgggtgctccggcaagttttaaattttttgaaaccactattgagcgtaaaagatataacaatctaaaagaactattaagctccaccataatctaccaatcaatcacaggactatatgaatcacgaaaaaggctggatgactaa

SEQ ID NO: 42 - DNA, 4098 bp, Lactobacillus sp.
atgacaaaattaaatcaaccatatggaattgggcttgacattggatccaactcgattgggtttgcggttgtggatgcgaatagtcatctcttgcggctgaaaggagaaacggccatcggtgcacggctatttagagaggggcaatcagccgctgatcggcggggaagtcggacgactcggcggcgtttgagtcgaactcggtggcggttaagctttttacgcgatttctttgccccgcatattacaaaaattgacccggatttctttttgcggcaaaagtattccgaaatttcgcctaaagacaaagacaggttcaagtatgaaaagcgtctgtttaatgatcgaacggatgctgaattttacgaggactatccgagtatgtatcacttgcgtctgcatttgatgacgcatacgcataaagccgatccgcgtgagattttcttggcaatccatcatattttaaaaagtcgcgggcattttttgacgccgggtgctgctaaagactttaatacggataaagtcgatttagaagatatttttcctgccttgacagaagcatatgcgcaagtttatcccgatcttgagttaacttttgatttagcaaaggctgatgacttcaaggcaaaactgctggatgagcaagcgacgccgagcgatacccagaaggccttggtgaaattgttattaagcagtgatggtgagaaagaaatcgtcaagaaacgcaaacaagtgctgacagagtttgccaaagcgatcacagggctaaaaaccaagttcaatcttgctttaggtacagaagtagatgaagctgatgcgtcaaattggcaattctcgatggggcagctggacgacaagtggagtaacatcgaaacttccatgaccgatcaaggaacggaaatatttgaacaaattcaagaactttatcgagcacgattgctaaatggcattgtgccagcggggatgagcttatcccaggcaaaagttgctgactatgggcaacataaagaagatcttgagctgtttaaaacctacctcaagaaactaaatgatcacgaattagctaaaacaattcggggtctttatgatcgatatattaatggcgatgatgctaagccttttttgagggaagactttgttaaagccttaaccaaagaagtaaccgcacacccaaatgaagtgtcggagcagctgttgaatcgaatgggacaggcaaacttcatgctcaaacaacgaactaaggccaatggtgcgattcctgttcaactgcaacaacgtgaactagaccagattattgctaatcaatccaaatactacgattggctcgccaaaccgaatccggtagagaagcatcgcgccagcaaaccatatcagttagacgaattattaactttccgaatcccttactatgtaggacctttgatcacgccaaaacaacaagccgagtcaggggaaaatgtcttcgcgtggatggtccgtaaaaatccttcaggcaatattaccccatacaattttgatgagaaggtggatcgtgaagcttcggcaaacacgtttattcaacgcatgaaaacgaccgacacttatttaattgacgaagatgtcttacccaaacaaagcctgttgtatcaaaaatatgaagttttgaatgagctgaacaatgtccgcattaataatgaagctctcagcacggatcaaaaacaacgcttgatccatgaagtgttcgagcggcatagcagtgtgaccattaaacaagttgttgataatttggttgctcatggagattttgcccaacgcccggagattcgcggactggcagatgaaaaacgtttcttaagttcgctttcaacttatcatcagttgaaagaaattttgcatggggcaattgatgactcgacaaaattgcatgatatcgaaaatattattacgtggtcgacggtttttgaagatgccgcaatttttaagaccaagttggccgaaattgattggttggatccagcgacaatcaagaaattaagcaacatccgttatcgtggctggggtcagttctcgcgcaagcttttagatgggttgaaactaggcaatggccacaccgtaattcaggaattaatgctttcgaatcataacttgatgcaaattttggccgatgaaacattaaaagaaacgatgacggaattgaatcaagacaaactgaagacagacgacattgaagatgtgatcaatgatgcgtatacttcgccaagcaataaaaaagctttgcgccaagtgttacgggttgttgaagacatcaagcatgcagcaaacggtcaagatccaagttggctgtatattgaaacggcagacggaacaggtactgctggcaagcgcacccagtcacggcaaaagcaaattcaaacagtttacgctaatgctgcccaagagctgattgatagtgctgtccgcggtgaattggaggataagattgcagacaaggccagctttaccgatcggctagtcctttatttcatgcaaggcgggcgcgatatttataccggcgcaccgctaaatatcgatcaactcagccattatgacatcgatcacatactgccacaatcgttgatcaaggatgactctttagataaccgtgtgctcgttaacgccaccattaaccgcgaaaagaacaatgtatttgcttcaactttgtttgcaagcaagatggcagcaacttggcgtaagtggcacgaagctggtctaatcagtgggcgtaaactcagaaacttgatgctgcgtcctgatgagaccgataagtttgcgcacggatttgtcgcgcgtcaattggttgagacacgtcagatcattaaattaaccgaacagattgccgctgctcaatatccgaacaccaagatcattgcagtcaaagctggcttatcccaccaactgcgcgaagaactagattttccaaagaatcgtgacgtgaaccattatcatcatgcatttgatgccttcttagcagcgcgaattggcacgtatctgcttaagcggtatccgaaattggcaccatttttcacatatggcgaatttgcaaaagttgatgttaagaagttccgcgaattcaacttcattggtgcactgacacatgctaagaagaatattatcgctaaagataccggcgagattgtttgggataaagaacgtgatatccaagagctggatcggatatacaacttcaagcggatgctgataacgcacgaggttcattttgagacggctgacttattcgaccaaacaatttatgcggccaaagactccaaagaacgcggtggaagaatgagcttaatccccaagaaactaggctatctgactgggatttacgggggatatcagacggagcggggaagctatgtaagcattattagaacctttaaaaaaggagagaccatttacaaagtagttaatattctcacggcagatgtatcgttactttctgaaaaggagaaggtttcaaaaaccctggccgatatttatttgaaagagttgattgcaaaaaagctatcaaaaggtaaatccgggaaaaacattgcaagtgaaccttttgagatcgttttacctcgggtcggaaaagactccctttttaaaaacaaaaagtatggtttgttcttaatagaatctgcaacagagcttcacaattatcaggagttgtggttaccaagaaatgaccaattgctgataaaaaggatacaagctcgtcaaatcgaagaatcaaaagcagactatgaattgaccaggatgtatcgcaatattgcatggcaggttgatcattatttcagactctacaagataagaaaatttgcagagaagttacaagcaagtgtggaggactttgcgggtttaccggtctataaaaatgaaacttccgatgggaaagtcgaagttcttgcgtctgtgctgaaaagacttaacggggccgcggataagggaagaaccaatccgacaacggtcaagttacagtcggatttcgggagaacgcttttaactaacggaatagttcttgaagacgattcaagtattgtctatcaatcaccgacaggactttttaaacgaagtgtaaagttagttgacttgtaa

SEQ ID NO: 43 - DNA, 4101 bp, Pediococcus acidilactici
atgggtgacagaaagtataaccttggtctcgatatcgggacgtcatcaattggctttgcggcagttgacgaaaataaccaacccattcgagttaaaggaaagacggcaattggggtacgcctctttgaagagggcaaaacggcggcggatcggcgtggttttcggactacgcggcggaggttatcccggcgccggtggcggatcaatttattaaatgaaatttttgatgcgcaccttgccgaggtggaccccacctttttggcccggttaaaagaatcgaaccggtcaaatttggatccaaagaagtcttttcaaggctcacttttattcccagaacggaaagattatcaattctatgaggaatatcccacgatttaccatttgcgaaaagcattgatggaagaagatcggaagtttgatattcgggaaatttatttagcagtccatcacattattaaataccgtggaaacttcttaaacggaacgccgatgcggtcgtttaaagtagaaaacatcgaactggatactttgtttgaccagttaaaccaactttacgcggaaattgttcctgataatgagctggcctttgatttagcacaagtggcggatgttaaggacgttcttagcagcacaaccatctataaaatggataagaaaaagcaactagtgaagatgatgctgcttcccgcaagcaacaaggcgttacagagcgaaaacaagaagatcgttacgcagtttgttaacgcgattttgaactataagttcaagcttgacgtgctcctccaagttgaaacggacgcggactggtccttgaagttaaacgacgagggggcggatgataaattagaagaattcacgggagatctagatgaaaatcgtttggaaattattgatcttttgcaaagactacataactggttttcactaaatgaaattacgaaggatggtaattcgttgtccgcggcgatggttgaaaaatatgaaaaccaccatcaccatttaggattattgaaaaaggtgattgagaatcatccggatgctaagaaagcaaaagcactgaaggaaacgtacacggcctacgtcggtaaaacggacgataagacccagaaccaagatgatttctataaggctgtggaaaagaacttagatgattcgccggatgcaaaagaaattaaacgtttaattcagctagaccagttcatgcctaagcaacggactgggcaaaatggggcaatccctcatcaactgcatcaacaggagctcgaccaaattattgaaaagcaatctaaatactatccatttttggcggagccgaatccaaacgttaagcgccgtaaagatgctccttacaaactagacgaattgattgcctttaagatcccgtattacgtgggcccgttggtaacgccggaagaacaagcacaaaataaagaaaacgtgtttgcgtggatgaagcgaaaggctgccggtccaattacaccatggaattttgatgaaaaagttgaccgaatggaatccgcaaaccgatttattcggcggatgactaccaaagatacgtatctttttggcgaagatgtcttacctgcggaaagtatgatttatcaaaaatttgtggtgcttaatgaactgaacaatttgaaaattaatgggcggcatttgtcacttaaggataagcaagacgtttataatgacttgtttaagcaacaaaaaacggtttccattaaagcgctccaaaattactacgttaccaagaagaaagccgcaaccgcgcctaccgtgggcggattggccgatccaaagaaatttttatcgagtttatcaacttatattgatttcaaaaatatgtttggggagcgggtaaatgatccgcaatttcaagaggacttagaacaaatcgtggaatggtcgacaatttttgaggatcggggaatcttcaaggcaaaattacaagccctgggttggctatctgaaaagcagattcaacaactggtggctaaacgttacaaaggatggggtcggctttccaagaagctcttaactgggctaaagaacgcggaaggatactcaattttagacgaaatgtggcgttcgaccgaaaacttcatgcaaattcaaactcgcccagaatttgcggcactgatccaacaggccaacgaaaagcaatttgagggcaacgatccgaataatgtttgggagaatattgaaagtattttgggggatgcgtacacttcaccacaaaataagaaggcaatccgtcaagtggtgaaggttgtccaagatattgaaaaagcagtgggtaacccacctgaaaaaattgcgattgagtttacccgtgaagccgcggcgaacccccaacggacgcaaagccgtttgcggaccttggaaaaactttatgaaagcgccgaagaagttgtagacgcggggttaactgctgaactagctgaattcaaggaaaataagcacgttttatcggataagtactacctgtactttacccaattaggccgggatgtttatactggcgacactattagtctagataagttgaacgattacgatgttgaccacattttgccacaatcctttattaaggatgatagtttggacaaccgggtattgacgattcgggcggttaacaacggaaaaagtgataatgtaccagctaaaatgtttggcaaaaaaatgggctcattttggcggtacttgctggataacggaatgatttccaaacgaaaatataataacttaattaccgatccggataatattagtaaatacgcccaaaagggatttattaaccggcaactcgtggagaccagtcaagtcatcaaactgacagctaacattttaaatggaatttacgataaggacaccgaaattatcgaagttccagcaaaaatgaattctcaaatgcggaaaatgtttgatttggttaaggtgcgggaagttaacgactaccaccatgcctttgacgcttatttaaccatctttattggaaaatatttgtataaatgttatccaaaattacggccatactttgtttatggcaagttcaaaaaatttggtgacaatgaagatatcgaagttggagacggacggtttaactttttgaatcggatcgaacggttgaaaaatgttacagatcctgagaccggtgaaatcttgtggtcaaacgtggcaccgaatgagaccatcaaacagattaagaaggtttacaactataaatttatgcttgtttctcgggaaaccaccactcgaagagcagaattatttaaccaaactgtttacccaaagaattatcgtggaaaactaattccgattaaagaagaccggcctacggatttatatggtggttatagtggaaatacggacgcctatcttgcaatcgttgccttagaagataaaaagaagggcaaatatttcaaggtggtcggaattccaactcgggcggctgccaaattagagaagttaaagcaacaagattcacagcagtatttacaggcgcttcataaagttatcgcgccacaatttacaaagagcactaaaaagggaatcaagaaaacagaattcgagattgttctagataaagtgcactaccggcaattagttcaagatggtcccgttaaaatgatgctaggcagttcgacatataaatataatgctaagcaactagttttgtcagaaaaagctctacaagtaattgcggatgaccgaaaatttgatgagacgcagaaagacgataatttaatcgcagtttacgatgaaatcttatcaattgttaatcaatcttttgatttatacgatatcaacggtttccggaagaaattaaatgataatcgggatcaatttattgatttgccagctgaaaccaagtatgaaggacgaaaagtagttgcccacggtaagcgtgaaatgattttagagattttgaagggattgcatgctaatgcggcttttggaaatttgaaaccaattggtttttcaacagcatttggacaattacaagtaccaaatggaattattttatctaaaaacgcaatcttaatccaccaatcgccatcaggattattcgaacgtaaaattaaattaagcgatctttaa

SEQ ID NO: 44 - DNA, 4077 bp, Acidaminococcus sp.
atgggaaaaatgtattatcttggtctggatataggaacaaattctgttggatatgccgtaaccgacccatcgtaccatttgctcaaatttaaaggcgaaccgatgtggggtgcccacgtgtttgctgcggggaatcaatcagctgaacggagaagctttcgtacgagccgcagacgccttgaccgcaggcaacagcgtgtcaaactggttcaagaaatctttgctcccgtgattagtcccattgatccacgtttttttatcagacttcatgagagcgctttatggcgggatgatgtggctgaaacggataaacatattttctttaatgacccgacctatacggataaggaatattattctgactatccaaccatccatcatctcattgtggaccttatggaaagcagtgaaaagcatgacccgcggcttgtttatttggctgttgcctggctggttgctcatcgtggtcatttcctcaatgaagtggataaggataatattggggatgtcctgagttttgacgccttttatcctgagtttctggcatttctttccgataatggggtgtcaccttgggtatgtgagtcaaaagcactccaagcgaccctgctttcacgaaactccgtcaacgataagtataaagccttgaagtctctgatctttggcagccaaaagccggaggataattttgatgccaatatcagtgaagatggacttatccaacttttagcaggaaaaaaggtcaaggtcaataaactttttcctcaagaaagtaatgatgcttcctttacactcaatgataaggaagatgcaattgaggaaatcttaggaacgcttacaccggatgagtgtgaatggattgcgcatattaggaggctgtttgattgggccatcatgaaacatgctctcaaagatggcagaacaatctccgaatcgaaagtaaagctctatgaacagcatcaccatgacttgacacagctcaagtattttgtgaagacctatctagcaaaggaatatgatgacatttttcgaaacgtagatagtgaaacaaccaaaaactatgtcgcatattcctatcatgtaaaagaagtcaagggtacattgcccaaaaataaggcaacccaagaagaattttgcaagtatgtccttggaaaggtaaagaacatcgaatgcagtgaagctgataaggttgattttgatgaaatgattcagcgtcttacagacaattcctttatgccgaaacaagtatcaggtgaaaacagggttatcccttaccagctttactattatgaactaaagactattttgaataaagccgcttcttatctgccttttttgacccaatgcggaaaagatgccatctccaatcaagataagctcctttccatcatgacctttcggattccgtatttcgttgggcccttgcgcaaggacaattcagagcatgcctggctggaacgaaaagcagggaaaatctatccgtggaattttaacgacaaagttgaccttgataaaagtgaagaagcgttcattcggagaatgacgaatacctgcacttattatcccggtgaagatgttttgccacttgactcccttatttatgaaaaattcatgatcctcaatgaaatcaataatatccgaattgatggttatcctatttctgtagatgtaaaacagcaggtttttggcctctttgaaaagaagagaagagtgaccgtaaaggatatccagaatctcctgctttccttgggtgccttggataagcatggtaaattgacgggaatcgatactaccatccatagcaattacaatacataccatcattttaaatcgctcatggagcgtggcgttcttactcgtgatgatgtggaacgcattgtggagcgtatgacctatagtgatgatacaaaacgcgtccgtctttggctgaacaataattatggaacgctcactgctgacgacgtaaagcatatttcaaggctccgaaagcatgattttggccggctttccaaaatgttcctcacaggcctaaagggagttcataaggaaacgggggaacgagcttccattttggattttatgtggaataccaatgataacttgatgcagcttttatctgaatgttatactttttcggatgaaattaccaagctgcaggaagcatactatgccaaggcgcagctttccctgaatgattttctggactccatgtatatttcaaatgctgtcaaacgtcctatctatcgaactcttgccgttgtaaatgacatacgcaaagcctgtgggacggcgccaaaacgcatttttatcgaaatggcaagagatggggaaagcaaaaagaaaaggagcgtaacaagaagagaacaaatcaagaatctttataggtccatccgcaaggattttcagcaggaggtagatttccttgaaaaaatccttgaaaacaaaagcgatggacagctgcaaagcgatgcgctctatctatactttgcgcagcttggaagggatatgtataccggggaccctatcaagttggagcatatcaaggaccagtccttctataatattgatcatatctatccccaaagcatggtcaaggacgatagtcttgataacaaggtgttggttcaatcggaaattaatggagagaagagcagtcgatatcctcttgatgctgctatccgtaataaaatgaagcctctttgggatgcttattataaccatggcctgatttccctcaagaagtatcagcgtttgacgcggagcactccctttacagatgatgaaaagtgggatttcatcaatcggcagcttgttgagacaagacaatccacgaaggccttggcaatcttactaaaaaggaagttccctgatacggagattgtctactccaaggcagggctttcttctgattttcggcatgagtttggtctcgtaaaatcgaggaatatcaatgacctgcaccatgcaaaggacgcatttcttgcgattgtaacaggaaatgtctatcatgaacgctttaatcgccggtggtttatggtgaaccagccctattccgtcaagaccaagacgttgtttacgcattctattaaaaatggtaattttgtagcttggaatggagaagaggatcttggccgcattgttaaaatgttaaagcaaaataagaacactattcatttcacgcggttctcttttgatcgaaaggaaggcctgtttgatattcagccactaaaagcgtcaaccggtcttgtaccaagaaaagccggactagacgtggtaaaatatggtggctatgacaaatcgacagcagcttattatctccttgttcgatttacactagaagataaaaagactcaacataaattgatgatgattcctgtagaaggcttgtataaagctcgaattgaccatgataaggaattcttaacggactatgcacaaactacaatcagtgaaatcctacaaaaagataaacaaaaggtgataaatataatgtttccaatgggaacaaggcacattaaactgaattccatgatttcaatcgatggtttttatctttccattggaggaaagtctagtaagggaaaatcggtgttgtgtcatgctatggtacctcttattgtacctcataagatagaatgttatattaaggcgatggagtcttttgcacgtaaatttaaagaaaataataaattaaggattgtggaaaagtttgataagattacggtggaagataacttgaacctatacgaactatttttacaaaaacttcaacataacccatataataagttcttctccacacaatttgatgtgctgactaatggaagaagtacatttactaaattatctccagaggaacaagttcaaacgttattgaatatcttatcaatttttaaaacttgtcggagctctggctgcgatttaaaatccattaacggttctgctcaagctgccagaattatgatcagcgcagatttaactggactctcaaaaaaatattccgatattcggcttgttgagcaatcagcatctggactttttgttagtaaatcacaaaatcttttggagtatttatga

SEQ ID NO: 45 - DNA, 4191 bp, Lactobacillus sp.
atgacgaaaagaatagatgattatattctggggctcgatatcgggaccaactcttgcggctgggccgtgactgataagaaaaataacttattaaagctcagagggaaaacagcaattggttcacatttatttgacgaaggacacactgctgctgagcgtcgcagttttagaactaccagaagacgacttaagcgtagaaaatggcgcttaggattgctggaagaaatatttgcggaaccaatggctaaggtagatccgggattctttgtgcgcctgcatcaatcatgggtttcgccacttgataaagatcgcaaaaagtatcaggcgattgtgtttccaactgctaaggaagatcaggcattttataaacattatgctacaatctatcatttgcgtgatgaattgatgacgcaagaccgtcaatttgatttgcgggaaatatttttagccatccaccacattgttaaatatcgcggtaattttttacaagatactcctgttaaagattttgaagcttccaaaattgaagtgggacccattttatcgcatatcaacaacgcttttgcggaaaagatagttgaagagcaagatcctattgaattaaatgtcgcaaacgctaccgatattgaggctgttatacggggtaaagatgcagaaaagaccgtttataagatggacaaggtcaagaaaattgccaagttattaacggattcaactgccaaggaagaaaaaaatttagccaagcagattgctaatgctattatgggctacaaaacgcaatttgaaactatcttaggcaaagaaatcgataaaagtgacaaggcgcaatgggaattcaaactgactgatggggatgccgatgataagcttgatgcattactgccagaccttgatgaaactgatcagactattattgccgaaattaaaaagctgtttagtgcaattactttaagtactattgttgatgaaaacaagagcttatcacagtcaatggtggccaaatacgacaaacatcaccaagattataagttgttaaaagcttatatcgacactttgcaggatcgcagtatagctaaaaagttgcttttagcctatgatttatacgttaataatcgtcatggtcgtttgctggaagccaaaaaaacatttgaagataaaaaaaagaaaaaagctttaaccaaagatgaattttataaaatagttaaggataatcttgacgattccgatcttgctcatgaaatacggcaagaaatagctgcagataacttcatgcctaagcagcgaacaaacagtaatggtgtaattccgtttcagctgcatcaaatcgaactagataagattattgctaatcaaagccaatattatccattcttagctgcagaaaacccagtagaagatcaccgtaaacaagcaccttacaagttagatgaactggttagattcagagtaccttattatgtaggtccgatgattacagccgatcaacagaaaaaaacttccggtaagagttttgcttggatggtcagaaaagaagatggtcagattacgccttggaattttgaacaaaaagtagaccgtcaagaatctgccaacaagtttattaagcgcatgactattaaggatacttatcttttaggtgaagatgttttgccagctaatagtttgctttatcaaagatttgaagttctaaatgagcttaataatattagaatcaatggtagtagaatcagcgtcgaccttaagcaacaaattttcaatgatctttttgaagaaaagaaaactgtcacagaaaaatctttgacaagttatttgaagcaaaatctccatttgccaactgtagaaattaaggggctggcggatccaactaaatttaattcaagtcttgcgagttattatcacctcaaaagcttacatgtgtttgataaggaattagcagatccacaatatcaaaaagactttgaaaaaataattgagtattcatctatttttgaagataaaaagatctttcaagataagttgcatgctgaatttaaatggttaacacctgaacagtttaaagctatttcaacttggcgcttgcaaggctggggtagattatcacggaagctccttgttgaattgcatgatacaaatggccaaaacattatggaacaactgtgggatagccaaaagaacttcatgcaaattgtgacagaaccagattttaaagaagcaattgctaaggaaaaccaaaatgttactcaagcaaatggtgttgaagagattttggctgacgcctatacttctccagctaacaaaaaagctataaggcaggtcgtcaaagtagtagctgatgttgtaaaagcagcaggtggcaagaaacctgcacaatttgcgattgaatttacacgcgaacctgataaaaatccaaagttgtcacatattcgtggcactaaattgctcaaagcatatcaggaaactgctggcgaactagtggatcagaagttaacggatagcttaaaggaagcgatgaccagtcgtaaattgctaaaagataagtactttttatactttatgcaggctggaagggatgcatatacggggcaaaaaattaatattgatgaagtatcgacaaattatcagattgatcatattttgccacagtcatttattaaagatgattcctttgataacagagtattaactgctactccgctaaatgcagaaaaatcggatgatgtaccttataagcgcttcgccaataattatgtttcagacctgaagatgacagtaggtgaaatgtggaaacactggcagaaggatggcattattaataagcataagctaggtaatttgctacttgatccagatagattaaataaatatcaaaaatctgggtttattaacagacagttggtagaaacaagtcaaatagtcaaattagtgtcagttattttgcaaaataaatatccagattcagaaattattacggttaaagcaggagataactcggctttgcgtcaacgtctaaacttatataagagtcgtgaagtaaatgactatcaccatgccattgatgcctacctctcaattatttgtggcaactttttgtaccaggtttatcctaagtatcgtccatactttgtttatggcaagtataaaaagttcagtcaagacccggacttgcagaaggaagttatcaaacacttcaagggctttacgtttatgtggccattattgcaaaaggataattctgagcgtaaagctccagaaaaaattaaagaaaataatagtgatcgaattgtcttttacaagcatcctgatatttttgataaattacgtaaagcatacaattataagtatatgctggtttcaagagaaacgaatactgaaaatagtggcctttttgatgtaactatttatccacgcggtgaacgtgaccttgcgaagactagaaagctgattcctaaaggtaatggactcgatccgaaaatttacggtggctatagcggtaacagtggtgcatatatggtaattgtcaaaattgagcaggcaaaaaaatctatttataaagttattggcgttccgatgcgcactcttgcaagtttaaaccaggctaaaaaacaaggaaactatcaaggagaactccacaaagtacttgagccgcagattatgtttgataacaaagggaaacctaaacgtggtgttaaaggctttagagtaataaaagatcatgtaccatttaagcaagtggtcttagacggtgacaaaaagtttatgctttattctgatcaatatgaagctaatgccaaacaactgacgctttctcaggagactatgcgaatagtgacagacaacttgaaaaagggcgaggatcaagatcaattactagtagaagcatatgatgagattttgcaaaaagttgatcaatatttaccactttttgatatgaaaggttttagaaatggtttgcataagggtagagataaatttattgaattatcaactaatgataagaaatctactttgagtaatattttaaatggcttacatgataatatggtagaaataaaaatggaatatttgggtataaggactccatttggacgtttgcaatcaagttctggtatcaatttatcaccagatgcagtactaatttatcagtcaccgactggactttttgaaaaacgggttaagatagccgatttataa

SEQ ID NO: 46 - DNA, 4188 bp, Treponema putidum
atgaaaaaagaaattaaggattattttctcggattggatgtaggaaccggatcggtgggttgggcagttactgatactgactataaactcttaaaggctaatcataaagacctttggggaatgaggtgttttgagacggcggaaactgctgaaaaacgcaggctatttcggggggcgcgccgccgcattgaaaggaggagaaaaaggataaagctgcttcaagaacttttttcccaagaaattgcaaaaatagatgaagattttttccaaagaatggaggaaagccctttctatgcagaagacaagactatattacaagaaaacactctttttaatgatagagattttaccgataaaacataccataaagcctatcctaccataaaccatctgataaaggcttggattgaaaacaaggtaaagccggatccacgattattatatttagcctgtcataatattataaaaaaacgaggacattttttatttgaaggtgactttgattctgaaaatcaatttgatacctctgtacaagctctttttgagtatctgcgtgaggatatggaactcgatattgatgccgatagcaaaaaaataaaagagattttaaaggatagcgctttaaaaaattccgataaacaaaatcggctaaataagcttttagggctgaaatcttccgacaagcaaaaaaaagctcttactaatttaatatccggtaacaaggcaaactttgccgatctttatgataatcccgatttaaaggatgcagagaaaaatagcatatctttttctaaagacgattttgatgctttaagcgatgaacttgcttccgttttaggagattcttttgagcttttgttaagagcaaaggctgtatataattgctcggttctttccaaagtaataggagatgaacagtatctttcttttgcaaaggtaaaaatatatgaaaagcataaaaatgatttgactaaactaaaagaagttgtaaaaaaatattttcctatagaatatcgaaatatattcggatataaacaatctgaaaataataactgtaattattcaagatatgtaggtgtgtgtaaaagcggaagtaaaaaaaaggttataaataaaactgcaagtcaagaagatttttataagtttttaaaagatattcttttaaaaagaagtgatgtgcctgaagcaaacggaatattaacagaaattgaaacaggaacctttctgccgaaacaaatttccaaaaacaatgcagaaattccttatcaattacgcaaaatagaattagaaaagatattaaccaatgcggaaaagtttttttcttttttaaaacaaaaagatgaaaacggtttatctcacagtgaaaagattataatgcttttaacatttaaaattccgtattatatagggcctataaatacttctcataaacagtattttcctgataggtcatgggtaataaaaaaagaaaatgctcctcaagagaagataactccatggaatttttttgatcatatcgataaggaaaaaacagctgaagcctttattacaagcagaaccaatttttgcacatatttaataggagaatctgttttacctaaaaattctcttttatattccgaatatacagttttaaatgaaataaacaatttacagattattattgacggaaaaaatatctgcgatgttaaactaaaacaaaaaatatacgaagagttatttaaaaaatataaaaaagttacacaaaaacagatttcaacttttattaaacacgaaggtatttgtaataaaacggatgaagtaattattttaggtattgataaagaatgtacatcttctttaaaatcatacatagaacttaaaaacatattcggaaaacaagtggatgaaatttcgacaaagaatatgcttgaagacattatacgatgggctactatctatgatgaaggagaaggtaaaacaatacttaaaacaaaaataaaagccgaatatgaaaaatattattctgatgaacagatcaaaaaaattctaaatcttaaactttcaggttggggtcgtctatcacgcaagtttcttgaatccattacatcagaaatacccggctttatcgaaccggtaaatataataacggcaatgcgtgaaactcaaaataatttaatggaattgctgagcagtaaatttaaatttaacgaaaacattaaaaaaataaattccggatttgaggataccgataaacgattttcatataacagtttggtaaagcctttatttttatcgccatcggtaaaaaaaatgttgtggcagactcttaaacttgtaaaagaaatatcgcatattacccaagctccgcctaaaaaaatattcatcgaaatggcaaagggtgcagaacttgagcctgcacggacaaaaacaagactaaaaattttgcaggacttgtacaatagctgtaaaaatgatgcggatgcttttagttccgagatacaatatcttttaggtaaaatagaaaatgaagataatttaaggcttcgcagcgacaaactttatctttattacacacagcttggaaagtgtatgtattgcggtaaaccgattgaaatagggcatgtatttgacacaagcaaatatgatatagaccatatttatcctcaatctaagattaaagatgatagtataaataaccgagttttggtatgcagcagctgcaataagaataaggaggacaaatatcctttgaagcctgaaattcaattaaaacaaaaaaaattttggaatttcttacaaagaaataactttataagtattgaaaaatttaaccgattaacaagaacgactccaatctcggatgacgaaacggcaaaattcattgcccggcaacttgtagaaacaagacaggcaacaaaggtagctgcaaaagtattagaaaaaatatttcctgaaacaaatatcgtttactctaaggctgaaaccgtatcaatgtttagaaataaattcgatattataaaatgcagagaaataaacgattttcatcatgcacatgacgcatatttaaatattgttgtcggaaatgtttataatactaaatttacaaataatccttggaattttataaaagaaaaaagagataatcctaaaattggcgatacgtacaattattataaggtttttgattatgatgtaaaaagaaataatatcacagcatgggaaaaagaaaaaacaattattactgtgaagactatgcttaaaaggaatacccctatttatacacgccaagctgcctgcaaaaagggagaactctttaatcaaaccattatgaaaaaaggattgggccaacatcctctaaaaaaagaatgtcctttttctaatatttcaaaatatgggggctataataaagtttctgctgcatattatacttttatagaatatgaagaaaaaggaaataagatacgaagcttagaaactatccctctatatttggaaaaggacattcaaaaaagtcaagatggattaaagggttacttaacagaccagctaggaaaaaaagaaattaagattttggttcccaaaataaaaatcaactcccttttaaaaattaacggcttcccttgccacataacaggaaaaacaggagcttcctttgttctaaggcctgctgttcaattttgctgttcaaatgatgaagttctttattttaaaaaaattataagattcaatgaaataagaagtcaaagagagaagatgggaaaaacaatttctccttatgaagacttatcctttagatcttatatcaaagaaaatttatgcaaaaagacaaaaaatgatgaaataggagaaaaggagttttatggctttcttcaaaagaagaatttagaaatctatgatatgcttttaataaaacataaggatactatttatagtaaaaggccgaattctacaactcttgatatgttaatcaaaggaagatatgagtttataaatttaaagcctgaagatcaaattagagttatgctggaaattctaaaattgttttgtactactagagaggtaatagatttaggattaatcaaaggtaaatctgaggccggggtcacaacattaggaaaaaaaatctcaaaccttgatagctgcattttaatttaccaatcaataacaggcatttttgaaaaaaggattgatttgttaaagatatga

SEQ ID NO: 47 - DNA, 4038 bp, Eubacterium sp.
atgggtaacaaattgcggaatgtggatgattattatttaggacttgacatcggcaccgagtccgttggctgggcggtaaccgataagtactatgtcattccgaagttcaagggcaacgctatgtggggcgtacatctttttgacgagggagagacctcggtgaagcgcagaggcttcagaagcgcaagaagacgcactcagcgaaaaagggagcgcttagccttgctggaagcgctctttgatgaagaaatttgtaaaaaggactgcacctttttcagacgtttacacgagagcgacttgtggccggaggacaagtccggcgacgataaatacgctgtttttgcagacgaaaattataccgataaggatttccacaaggaatatcccacgatatatcacctgagatacgagcttattaaaaataaagagccgcacgatgtaaaacttgtctttttggctcttcaccatattatcaaaaacaggggacattttctctttgattccctgtcatcggcagaggactttaattcggcatacgaaactatgtgctcttatctcagtgataacgaaatacagcttaattgctccgatattgagcaatttaaagctatattaaaggacaggcgtcagggtaaaatagaaaagacgaagaatcttgcctcgcttttcggtataacaaaaaaatccgatcccgtttcttacgccgtaatggcggttttaagcggctcgactgttaaaatgtgtgatttgtttggcgatgatgaactaaaaaccgtagagaaaaacaatatatcttttgcaagcggctatgaagaaaacgaagaaatatacgcgtccgttttaggcgatcgctttgagcttgtcaaaattttaaaggctgtatatgattgggccgtactcgccgatattttggacggtaagaagtatatctccgaggcaaaggtcgccgtatatgaaaaacataaaaatgatttaaaaacgcttaaaaaatatgtcaaaacttatttaccggaaaagtataacgagatatttaaaataagcgacggcaaaaaagacaattatgtggcgtattccggtcacattaaggaaagcggcaaaacaggcgagcttaaaaagacctgtaattccgagaatttttgcgcttatcttaaaaagacgctcggcaaaaacgccgatttgtcatataaggaaatgtttgacgaaattgagaataagacctttatgccgaagcaggtgacaaagagcaacggcgtagttccgatgcaggtaaatgaggaagagcttaaagcaattttggataatgccaaggattatttgtcgtttttaaattcgtgcgatgaaaacggtgtttccgtgtacgataaaattatcaaaatatttgagtatcgcattccgtattatgtcgggccgcttaatactcataccgaaaacagctggcttaaaagaaaagacggcgtaaaaatatatccgtggaactttgacgacgttgttgatattgactcttcggctgagaaattcataaacaacctcacaagtaaatgcacctatttgccggagtgtgacgttattcccaaatgctctcttctctattcgaaattcaccgttctcaacgagataaacaatctcaaactgaacggcgaggatatacccgtcgaattaaagcaggggatttataaagatttgtttatgactcgccgcaaggttaccgtaaagcaaattaaggactatctcaaggcaagaggctgttatgataataacgacgtattgagcggaatagatacaaccgtaaaatcctcattgaaatcttattttgattttaagggttttgagagcctgacctttgatgacaaggagagtattattgcgtcatcggtaattttcggcgatgataaaaaattactcaagaaaaggctgaaaaagcttttccctgaaaagctgacggatgaagacatcaaaaaaatatgcaagcttaagtacaccggctggagccgcctgtcaaaggagtttttgtgcgatgtcgagtttacatataaaaagaccggtgaggttatgaatgtcatcacggctctttgggaaacgaattacaatttgatgcagattttatattccgaagatttctgctgtgacggcgatgaaaaaaagaatttaaatgacaagcttgatgagctcagctatacaggtgatcagcattctctgcgcaaggctgttgacgcgctttacgtttctccgaaggttaagcggccgatattgcgtgcgttgctgattgcaaaggaaatagaaaagatacaggaaaggcctccgaagaagatattcgtagaggttgcaagaggtattgataacagagaagaaagacacagggactcaagaaaaaacaggcttatggaattatacaaaaactgtaaaaaggaagccgaaaaattctgcccgtatttcgatgccctgagtaaaaagctgagtgatgaagacgagtcaaagctcagacgtgacaagctttatttctattatattcagctcggcaaatgtatgtatacgggtgaggaaatatccctcggcgagctgatgaacggtaacggccgctttgatattgaccatatttatcctcggtcgaagataaaggatgacagccttacaaacaaagtccttgtcaataaaacagtaaataacaataaaaccaatgtttatcccattgatgcggctatacagagcaaaatgagtccgtattggcagatgcttcgtagcagcggactgataagcgaggaaacctataagcgtcttacccgtaaaacgccgcttaccgatgatgagctctccgcgtttgtgtcaaggcagctcaccgaaactcagcagtctacaaaggccgttgcgcatatattggagcagctgtacccgaagccgaaaaccgaaatagtctatgttaaagcggctttggttcacgccttcaggcaaagcaacgatatgctcaagtgccgtgaggtgaacgatttgcatcacgcaaaggatgcttacctcaatattgttgtcggcaatgcatacaatgtaaaggtcactcataataaggtgaatttcataaaaggattgcaaaacaacgataaaggatataccgtaaatcccgaaaaatttttcagccacgatatacccggcgcgtggtcggttaaggacagtatgaataccgtccgcagatttatgaacaagaacaacattcgctatacaaggttcccgcgcaaaaagcaaggaggactgtttaaaatcaatcctttgaaaaaaggaaacgggcaggttccgctgaaggcttcgggcgcaagaagctgtattgaaaaatacggcggatacgataaagcgacctcggcatatttttcgtatgtggagtataccgacaaaaagggcaaagccgtgcgtcagatgttccccgtcaatctgtatgaggtgaaagaatatgaagccgatatgcagggctttgttacaagccgtatagccgaagcttcaaacgtaaaaattctgattccctgcgttaaatatgacgcctgcatatcctttgacggctgcagaatgtttataaccaaaaagaccggaaatcggataggatataagcccggaatgcagcttgttttgggatataaatatgaaaagtatataagaaatatcgaaaattacctgacaaagcataaggacagggagattattccgagggacaatatttcagcagaagaaaatattgagctttacgatatcttaacgggcaaaatgctaaatacggttttgagtgtaaaattcagcggcatcggtaaaaagctcgaaaaacgccgtgaaaaatttgtgctctgctcaccggaggagcaatgctgcgtcttaaatgaaattctgaaaatccttcacgccaatgtgttgtcgggagaccttagtcttataggtgaaagtcctaatacaggtactatgaagaccaatgctaagttctccgaaattaaagacgttcatagcataaagctaatcaatcagtcggtaacgggcctttttgagcaggaaatcgacctgctgaaataa

SEQ ID NO: 48 - DNA, 3720 bp, Bifidobacterium bombi
atgtctcagcacaggcgctatcgaatcggcatcgatgtaggattgaattccgttggtttggcggccgtcgagattgatgccaatcacgataatccattggatgagattcctatcagcattctgaatgcgcagtcagtgatccatgatggaggggtggatccagatgaggcaaaaagcgctacatcgcggagagcaagcgcaggagtcgcgcgtcgaacccgaaggttgcataaaagcaaacgtcaacgtctcgcaaaactcgacgaagtcctgaacgaactcggataccctgtcgaagacgagtcgcaattccctgccggatcaaacccctacatcgcttggcaggtgcgtgcgaagctcgcggagacattcattcccgatgttgaaactcgcaaaaggatgatatccatcgcaatacgccatatcgcccgacatcgtggttggcgaaacccgtacagctcagtagccgatgcggaacgtatgtcacatactccctcaccgttcatggtcgagtatgccaaaaaacttgatttcgaaataaatgacagaagaaccaatggcttttaccattctccttggcaaagtgtggatgaggaaggcaaaaggctatccaaatcagaattggaaaaacaaccaaaaatcgaagattggaacgacaatccaatcaatggaaagaccatagcccaattggtcgtctcttcgctagaaccgcaaaccaagatacgcagggacctgacacacggacttcaaactgaatcgacgttgaatattcagaccgagaaactgcatcagtcagactatattcacgaattagagaccattttcgagcgccagcacgttgatcagacgacgcaagaacaattactggaggccactttccataccaaaaatccaaaggcagttggagctgctgcaaaattggtaggaaaagatgcccttgactctcggtactatcgagccagtcgagcaactcccgctttcgaggaataccgggtcatggctgccatcgacaccttaagaatacgtgaacatggaacagaacgtcaactcacaacagacgaacgccgaaaactgtttgacttcatcaagggactgccttccaaaaaaacgaagaacgaaccttcaattagctctcttacttggggtgatgttgctgactttctcggaatacaacgaatcgacttgcgcgggttaggctctcttaaagacggagaaccggtgtcggcaaaacagccgccagtcatcgaaaccaacgacatcatgcagaaggcccctgaccctattgcagcttggtggtcacaggcgaacactaaagaacgagaccgtttcgtcgagttcatgtcaaacgcgggcgcaataaaagatacatcagatgaagttcgtaacatcgatgcggagatttcacaactgttggaagaactaacgggctcagagctcgaatccctcgacaagattacccttacttcaggaagagcagcatacagctctcagacgttacgcaacatcaccaactacatgtacgaaaccggctgtgatttaacaaccgcacgccaagagctctatcatgtcggcaagaactgggctcccccagctcccccaatctatgagcataccggcaatccatcggttgacagaacgttcagcatcattcatcgctggctatgcaatatgagagaccagtatggtgaaccagaaaccgtgaacatcgagtatgttcgagatggtttctccagcacgtccacacagctggctgaacagagggaacgcgataggaggtatgccgataaccttaagatgttgtctaactacgaaggagcaagttcacgctcagacgtccgccgcatcaaggcacttcaacgccagaattgccaatgcatttattgcggacgtaccataacgttcgagacctgccaaatggatcacgtattgcccagaaagggccctggatccgattccaagttcgaaaatctagttgccacatgcggcgaatgcaataaaagcaaaagcgataccctctacatgaattgggcgaaaacgtacccaaatactaatttgcaagacgtcctgagacgaattcaggagtggagcaaagatggttggatgaccgacaagcgctggagacaatataaggaagcgctgattctgagattggaagcaacggagaagcaagagccactggacaacagatccatggaatccgtctcatacatggcaagggaactgcgcaatcgcatttacggtttctacggttggcacgatcaagatgacgcactcaaacaaggcaggcaacgggtattcgtttcatcaggctcgatgaccgcagccgcacgaagaacgccatttgaaagccctctgatcaaaggcgcagacgaagagacgtatgaatcatcattgccctggcttgacggtatgaagggcaagacccgtctcgataggcgtcatcatgccgtcgatgcgagcatcatcgcgatgatgcgccctcagattgtaaaaatactgacagaagcacaggagattcgttctgagcagcacgacaagtacaggaaaggtcagacgccggactacgtgtgcaagcgtcgcgattattggcgcaattggagaggcacgccagacacgagagacgaagaggtcttcaactattgggctggcgagcagctaagaacgcttacggatcttgtgagccagaaaatggcggatgatgaaatacccgtcatctatccaacaaggctccgactgggcaatggaagcgcacacaaagataccgtcgtctccatgatgacaagaaaggtcggagacgaattaagcatcacggccattaataaagccgaatccggtgcgttgtacaccgcgctgacacgggattctgatttcgattggaagacgggtttgtcggcaaacccgaaccgtcgcatcagagttcacgataagtggtttgaagctgatgacaccatcaagttcctggaaccggctgttgaagtggtgctcaagaataacacgagagccagaatcgacccggaagcgcttgataaagttcacagtacgctttatgttccagtccgcggtggcatcgcagaggcaggaaattcaattcaccatgtacgcttctataaaattccaaaattgaattctaaaggcaaacaaacaggtagcatttatgccatgcttagggtgctgaccatcgatcttgctatgaaccagtacgataaagaaaccggcaaaaaacaagatctattcacacttccactcccggaatcctcattaagcagaagattcagcgagccgaagctacgtcaggcgttgattgacggcactgccgaatacttgggttgggctgttgtggatgatgaacttgaaatccctgcattcgcaaacgccaggataaccgaagaacaggccattaacggcagcttcacagataggttgctccattccttcccaggaacccataagttcagattcgctgggttcagtcgaaacacagaaatagcaatcagaccggttcagctggcatcagaaggattaatcgaaacagacgaaaaccgcaaaaggcaacaactacgactcactcaacccaatacagaatatagcaacagtattaaaaatgtcctaaagagtggcttacacttgaaagtcaacacgttattccaaaccgggattctcgttacccgtgccaactctcagggtaagcaaagtattcgattctcaacagtagaagaataa

SEQ ID NO: 49 - DNA, 3288 bp, Corynebacterium camporealensis
atgcagaagaactaccgcgtcggtatcgacgtaggcacccactccatcggattcgccgcgattgaggtcgacgatcacgatcgtccgatccacatcctctccgcaatgtccctcatccacgactccggtctggatccggatagtaacaagcgcgctctcactcgactcgccgaatccggtgtcgcacgtcgcacgcgccgcctctaccgccgccgtcgcaagcgcatggttcgcctagagaagttcctgcagcaccagggatgggaaaccaaaccctttgaggattactctgacccctatatcccgtggaacgcacgggttgctttggtcaatggttatatcgaggatgatcaacaacgcggtgagtacctttcaattgctcttcgacacatcgctaaccaccgcggttggcgcaacccctactggaagactcgtagcctttacagtcccgaaggcccaagtgatgcctttgaaaccatccgtaaggatctagaaaagcgtgccggccgcccagtccccaaggacatcaccgttggacaactcattactttcgctcgcatcggtactgaccgaattcgcggcgaagcacaaaataagaagaccggacacaataaccctgcaatcctctctgcccggctgcatcagctagaccacgcacgcgaaattaacgagatcgcaaaggtgcaaaagcttgacgacgatcttcgcaagcacattatcgacctcgtatttgccgctgaatcgcccaaaggagcccaacttggtcgcgtcggtaaagatccccttcaaccaggtaaagatcgtgcactcaaggcaaccgatgccttccagcgctaccgtatcgcagcactgactggaaacctacgcattcgcggcactcaagggaacgaccgacttactcgagaacaacgccaactaatcttcgaccacctggttaatcttccccacaccgaagaaccttcctggctcaacattgctgagattctaggaatcgacaggggtgatctacttggcactgcaaccatgactgacgacggtgaacgggccggcagtaagccaccagtgcacgacactaatcgtgcgatcctcagttccaaggtcaaaccactggttcattggtggaaggctgctaacttcgacgaacaaaaagccatgcttaagtccctttccaacgcagaagtcgatgacttcgactctccagcgggtgccagcgtgcaggctttcttcgccgacctcgatgagaagcagcacgacaagcttgattcactgcacctccccatgggccgtgctgcttacagcgaggacacgttagttcggctcaccgaaaggatgctgaacaacaaccaggatctctacgaagctcgcctggccgaattcaacatcgccaaagactggacaccacccaaaccgcgtatcggcgagcccgtaggaaatcccgctgtcgaccgcgtcctcaaggcaaccgcacgttggctcgaagcagcgcacaaagagtggggtgctccaaagagcatcatcattgagcacgttcgtgacggttttatcagtgaagcgaaggctcgcgaaatcgaccgtgacaacaaccgccgcgctcagcgcaaccgtgaactgttcggaaagatgcaaagcaaactcggtatcgagggcaaaccacgctcagccgatctctggcgcttccagtccgtccagcgacagaactgttgctgtgcttactgtggagacaccatcaccttccagaattgcgagatggaccatatcgtccctcgtgccggcgaaggctcaacgaacacccgcgacaatctggtcgctgtttgccaccgttgcaacctggcaaagaagaacatccccttcgcggtgtgggccaagaatgccaacatccctggtgtcagtttgaaagaagcactgaatcgcacccgccactgggttgaagataccggtatgtcatccaaggatttccaacgctttgtcagcaacgtccgtgcacgtctgaagcgcaccagtgtcgacgaaccactcgataatcgttctatcgaatccgtagcctggatggccaacgagctacgcagccgcgtcgcgcaacactttggtgaatacggaaccaaagtcggcgtttaccgtggtgagctaaccgccgaagcacgaaacgccgctggaattagacgcaagcttcgtttcatcgatggcactggcaaatcacgcctcgaccgtcgccaccatgcagtcgacgctgctgtcatctgctttacccaaaactacgttgctgaagtcctcgccaaacgctctagtatgcgccgcgccgcacagcttaaccgtgagccggagcaatggcgtgagttcaccggcagcaccgatgcgcaccgcgctgcatggaatgcatgggtcaacaagatgcacctccttgctaaccttttgcaaactgcccttgatgaagaccgcatcgtggttacctcaaaccttcgccttcgtctggggaatggtcgtgcccacgaagacaccattggtgagctaaagaaaattcgtgttggcgacgctatctctgtcactgacatcgatcgtgcctccaccgaagcactatggtgcgctctcacccgcgatcccgacttcgatccaaaggaggggctgcctgaaaaccctcaccgccgcatccgcattcatggcacctggtatgacgccgacgaccacatcgaggtattccccgtcggcgccggcgcgatcaaggtacgtggtggttacgccgaactcagccgtttccaccacgccagggtctacaagatcacctcaggcaaaaagccaacctacgcaatgctccgcgtctacaccacagatctcactgcataccgcaatgaagacctcttcagcgtagaaatcaagccccagaccatgtcgatgcgccaagcagaaccaaagctgcgcaaagcaatcgcggaaggacaagccgaataccttggctggattgtcatcgacgacgaactactcatcgacacatcttcatttaactctggacagattgccgagatgcaagctgaatttggcatggtgaggcgttggaggctcgatggcttcgtttctccctcaaagttgagactacgacctctccagatgagtggagaaggactagcccctggggccagcgcgggttcaagaaagattgttgaccagcccggctggcgtcccgccgttaataagctgttaagtgcgggtaacgtcaccataattcgacgaaattccctcggccaggttcgcttgaatagtaatgctcacttacccaccacgtggaaggtggactag

SEQ ID NO: 50 - DNA, 4119 bp, Legionella pneumophila
atggaatcttctcagattttatcccctataggcatagatttgggcggcaaatttacaggggtttgcttatcccacctcgaagctttcgcagaactcccaaaccatgcaaatacaaaatactctgtcatcctgatagaccataacaactttcaattatcccaggcacaaagaagggcaacaaggcatagggtcagaaataaaaagaggaatcaatttgtaaaacgagttgccctgcaattattccaacacattctttcacgagatctaaatgcaaaggaagagacagcactctgtcactaccttaataaccgaggatacacttatgtagatacagatttggatgaatatataaaagacgagactacgattaatttattaaaggaattactgccctcagagtcagaacataatttcattgattggtttctgcaaaagatgcaatccagtgagtttaggaaaatattggtatctaaagtagaagaaaaaaaagatgataaagaattaaaaaatgctgtaaaaaacatcaaaaatttcattactggctttgaaaaaaacagtgttgaaggccatagacaccggaaagtgtattttgaaaacatcaaatcagacatcacaaaagataaccaacttgatagcataaaaaagaaaatcccttctgtttgtctctctaacctgcttggacacctaagtaacttgcagtggaaaaacctgcaccgctatctggcaaaaaaccccaaacaattcgatgaacaaacttttggtaatgaatttcttagaatgcttaaaaacttcagacatcttaaaggaagccaagaatctttagccgttcgcaacctaatacaacaacttgagcaatcccaagactatatatccattcttgaaaagacaccacctgaaattactattcccccctatgaggcccgaacaaacacaggtatggaaaaagaccaaagtctattacttaaccctgaaaaacttaataacctttatccaaactggcgcaatttaataccaggaatcattgatgcccaccctttccttgaaaaggacttagaacataccaaattgcgtgatagaaaacgcataattagcccgtctaaacaagatgagaaacgagactcttacattttacagcgatatttagacctcaataaaaaaatcgataaatttaaaattaaaaagcaactctcgtttcttggccaggggaaacaactaccagccaatttaatagaaacacagaaggaaatggaaactcatttcaactcttcattagtgagtgttcttatccaaatagccagtgcttataacaaagagagagaagatgctgcccaagggatttggtttgataatgcattcagtctttgtgagctatcgaatattaatccaccacgcaaacaaaaaatactaccacttcttgttggagcgatactcagcgaagatttcatcaacaacaaagataagtgggctaaattcaagattttttggaacacccataaaatcggacgcacttcattaaaaagcaaatgtaaggaaatcgaagaagcacgtaaaaactcaggtaacgcatttaaaattgattatgaagaagccctaaaccatcctgaacatagcaacaataaagctctcatcaagataattcaaacaataccagatatcattcaggccatacaaagtcatcttggacataatgactcgcaggccttgatatatcacaacccatttagtctttcgcagttgtatacaatccttgaaaccaagcgagatggttttcataaaaattgtgtagcggttacttgtgagaactattggagatctcaaaaaacagaaattgaccccgagatttcatatgcttcaaggttgcctgccgacagcgtaaggccttttgatggtgtactggccaggatgatgcaacgcctggcttatgaaattgcaatggccaaatgggaacaaataaaacacattcccgataactcaagccttttaattccgatctaccttgaacaaaaccgttttgaatttgaagagtccttcaaaaaaatcaaagggagcagcagtgataagactcttgaacaagccatcgaaaagcaaaacatccagtgggaagagaaatttcaacgcattattaatgcctccatgaatatttgtccatataagggcgcatcaataggcgggcaaggagaaattgaccatatttatccgcgctcgctttcaaaaaaacattttggagtaatttttaatagcgaagtcaatctcatttactgttcttcccaaggaaatcgagagaaaaaagaggaacattatcttcttgaacatctaagcccactttatttaaagcaccaatttggcactgataatgttagcgacatcaaaaattttatttctcaaaacgttgccaacattaaaaaatatattagttttcatttgcttacgcctgaacagcaaaaagcggctaggcatgccctctttctagattatgacgatgaagcattcaaaacgatcactaagtttttaatgtcccaacaaaaagcgcgtgtcaatggaacccaaaaatttttaggaaaacaaatcatggagtttcttagcaccttggcggattccaaacagctccaattggaattttccataaaacaaatcactgccgaagaagtacacgatcatcgtgagttattgtccaaacaggaaccaaaattagtcaaaagtcggcaacaatcgttcccaagccatgcgatagatgcaacgttgacaatgagcataggtcttaaagagttcccgcaatttagtcaggaacttgataattcctggttcatcaaccacctaatgcctgatgaggtacatttaaatcccgttcgatccaaagaaaaatacaacaaacccaacatcagcagcacaccgctgtttaaggattctctttatgccgaacgattcatccctgtttgggttaaaggcgaaacatttgctattggtttctcagaaaaagatttgtttgaaataaagccatccaataaggaaaaattgtttacccttcttaaaacctattccactaaaaatcctggcgaatcgttacaggaattacaggcaaaatccaaagccaagtggttgtatttccctataaataaaactcttgctcttgaattcttacatcattatttccataaagaaatagtcacaccagatgacacaaccgtttgccatttcataaatagcctacgttactacactaaaaaggaatccattactgtgaagatattaaaagagcctatgcctgttctgagcgtaaaattcgaatcttccaagaaaaatgttttaggctcttttaaacatacaattgctttgccagctaccaaagattgggagagactctttaaccatccaaactttcttgcactaaaagccaaccctgcccccaacccaaaagagtttaacgaatttatcaggaagtattttctttctgacaataacccaaattcggacattccaaacaatggacacaacattaagccacaaaagcacaaagccgttcgaaaagtattctcactgccagtaatacctggtaatgcaggcaccatgatgcgtataaggcgcaaagataataaaggacaacccttataccaactgcagaccattgatgacacccctagtatgggaattcaaattaacgaagacaggctagtcaaacaagaagtacttatggatgcttataaaaccagaaatttatcaacaattgacggaattaataactccgagggacaagcgtatgctactttcgataattggctaactctgcctgtttcaaccttcaaaccagaaattataaaactcgaaatgaagccccactccaaaaccaggcgctatatacgaattacccaatctttagctgattttattaaaaccattgacgaggctttaatgattaaaccctccgattcaattgatgatcccttaaacatgcccaatgaaattgtttgtaaaaacaaattattcggtaatgaattaaaaccacgtgatgggaaaatgaaaattgtatcaactggaaaaattgtgacttatgagtttgaatccgattccacaccccaatggatacagacactctatgtcactcaactgaaaaaacaaccatga

SEQ ID NO: 51 - DNA, 3120 bp, Environmental metagenome
ttgatatactcagccaatagtatggcacaagtcgaaggagatgtcaagaaccgcatgaggaagtacattctcggcatagacctcggggtcaactccctgggggcggcacttatcgactcggaaaatcaagcgattgtgtggacaggtgtccgaatcttctcggggccgttcgagggcgattattcgtccggcattgaggaatctcgcgcccggcagcgtcgcaccaagcgccagctgcgccgccagattgaccgccgacggcgccgcctccagcgggtattcaccctccttcaacgtttcggcctgctgccctcaggtgaacgaaggactgtgctccctgcccttgatgcggaactgcggaagcgatatcccgaaactgaaacactgccgtacttccttcgcggccgagcgctggacgtgaaactggagccattcgagattggacgctgcctttaccacctcgcgcagcgccgcggattccaaggccgcactgctttcgcggacccagaggagaaaagcgggggcaagttcggagatgaaatgaaaggcttgtggaacgagatttgttccagcggtgcgcgaacgctcggcgagttcctcgcccggcaacctgcgagggaggtccggctgcgcgggcggcatacgcatcgcctcatgtacgagcaggaattcaatctgatttgggatgcacaaaagcagcaccatcctgaaatcctgacccccgagcacaaggctctgttattccaggccctattctttcagcgacctcttaaatccgtcacacacttgataggcgactgttctttggagcggggggagaagcgtgcaccatgttggaccttgcaagtacagcggttccgagtcctcagcgccgttaacaacctgcgcgtggtggagcctagcggcaagataaggcctctcgaaccccaggagcgggaacttctggccgcggaatccctccggcgagagcaactcaagttttccacgattcgccgcatactgaaacttgacaaggattgccgcttcacagttgaagagggcggcgaggactgcattccgggcaacgccacctccgccagaatctataaggtgatgggggacgagtggctgaagtggccgcaagacaggcaagaagcccttgttgctatcctcggggatacctctcgttaccccacagatgacgatttagtgaaagagcttgtcacagctctgggcttgcccccggagaacgcgacaagactttgtgcggtggccttgcccactggctatgcctctatctcccttaatgccattgccaaagtcacgcctcgtttggagaaagggatgacattcgccgaagcgagacgcattctttggccggaagacttcacggagaaaccaccgttggcattgctgccccccgtctgtgacaccgatctcaagagggaactccggaaccccgccgtgctccgcgccttgagcgagctgcgcaaagtcgtgaacgccgtaatccgggaatttgggaaacccgtttcgatccacattgagctttctcgggacttgaagcgcaaccgtaaggagcgtcagcaggaaagcgagaggatgcgatcgcgtgaaagggcacgtagtcaagcccgcactgcattggccccttactatggcgaaaacgtgccgaaccgcgaaatcgagaaatacctcctttgggaagagtgcgggcatcggtgcccatacactggtgaagtggtcgccctgtcagacctctttggaccctatccccgcttcgaagtggagcacatcattcctttcgaccgctgtctggacgattcattccaaaacaaaacattgtgcgaaatcaacaagaaccgcgagaagggcaagcgaaccccttgggaggcctttgggcatacgccggaatggcctagcatggtcgaacgtgtccgagcgttcggaaactccgccaagctccgccgctttattatcagggagacggaggctgaaaggcttctcgaagagttcagttctcggcagcttaacgatgcccgttacgcgtcccgccttgcggcgcgttaccttgggctcctatatggaattcaaggctccgacaaccggcgcatcatcgtatgcgcgggagccgtgacagcttatctgcggcaggagtgggacctgaaccgcatcttaagcgcgcagcccgtcaagagccgggaagatcaccgccatcacgccgtcgacgctctggcggtggcgctggccacaccagctcaaatcaaagcgctggccgagtgcgcctcccgtgccccccaggtgggacggcgtcgcttcgcgccgctgcctgatccttggcctggatttcgcgatcaggctcgccgggccatcttgggcaccttagtctctcaccggcctcagcgtaaactcaaggcggccctccacgaggatacctattacagcccgcctgtggaacgggacgggaaacttagtgtgcgttgccgaaaacccgtgaacagcctcagcgcgaatgagatcaacgccattgtggaccccactgttcgcgaaactgtccgcaaggcttgggaggaggttgggcgggactccaagaagctgctcaacaattggccactccttcaaacgcggcgtggagatttggtcccgatcaagcgagttcgctactacaaaacccaacaggtgcaacccatcgctgcggaggacccagctcgcacccgatacgttatcccgggcggcaaccatcacatggagatatgggcggttttggaccgtagcacggggaagccgatcaagtgggcatccgagaccatctctgtgctcgaagctcacaggcggtaccggcaaggatcgccgatcatccagcgcgaccacgggcctgacacccgcttctgtttttcgctgagcgagggcgacttggtcaagacgcgccgctcggaaagagattccgagcgaatatggtacgtgcgctccgtcaaagccgatggaagggtggttatgtcgcccgccacggacgccaggaagaaggaagatataagcaagagcggcgaactatggcaggtgtcggtcaatccccttatgcggctgggggctgccaaagttgtggttaccccgctcgggaaggttatttacgcccatgactga

SEQ ID NO: 52 - DNA, 4065 bp, Environmental metagenome
atgagtacaaaaaaaattgttggttttgacctcggaacaaactctgttggatgggctgttgtagaaaacagtgatgaaaatgctgcaaaaattgctggagctggctccagaattcttccacttgatccgaaaattcttgatgctttcgaaaacggacaaaagcttacgaaaaatgctgaaagaaggcagaaaagaagtcagaggaaaacacttgacagatatcagttaagaagaaaatatctaattgaaagccttatcataatgggttgtcttcctgaagatttcacacctcagaatgcagggagaaaattcaaggaattaattgaaaaaccggatgagttaaaaaatttgcctgacgattggtatgtttatatgctccgaagtaaagcattgaaagaaccagttacacaaatagaatttggaagaatcctttatcaccttaaccagagaagaggatacaaagatattggagaattgatggaagaaatagaagagaaggacgatactaagcagggaaagaaatatgataaatggattgaacaggtaaccatttatagtgtagaaaaaaaatctgatttgaaaaataaaaaacaggagtattgggttattctcgatgatggaagagaaggaacatcaatcattgcaaacatcgaatcattgactgggaaggaaatagaactggaaatacgaagacgcgttaaaaagaatagcgaagaaacttttgaatttgcactacctaaccgcaatgactggcaaaataaactggacgctctcgataaacagataagccagtcaggaatgcatgtaggagaatttttctggaacaagattaaagaagacaggtatttcagaattagacaaaattttgtacatagggaaaaatacattgaagaattcgatgcaatttgggaaaaacaacaagaattcatacccgctcttattgacgaaacagttaagcaagatgttattcaaagaattgtcaggaatgagaaagaacgacaaaaatgggccaaaaaaccattgaaagagtttataaaaaattacatcatctattatcagagacccctgaaatcacaaaagtcaaaaaaagccaactgcagattcgagccaatgattaaggttattaatcagagcactggcgaaagtttaagtatcgaaaataaatgcatgcccctttcatcaccactttacgaagaattcaggatttggcaaaagcttaataatttaaggtataaagatattaataataaaaattatgaattaacaaatgaacaaaaggaagctttgtttgaaaaactaaataatggacaaactttaaaagaaagttctatttttaaaatacttggacttgataaaaatttatatagtgattttaatttcgaccaaattgagggacatactgtaaaatcaaaaatcgcaagcgtacttaaagattacgattcgggaaaaataataggaaacgaagaatttctttacaaagtctggcatcttttatattcggtaaatgaaactgaataccgaaaaaatacactgatcaaatggtttaatcttaccgaagaagatgctaaaagattggcaaaagtaagattcgaaaaaaaaacaggaagtttatcatcgagagcggtaaaaaaactcttacccctaatgcgagcgggaaaatattttgatgaacaatccttgcacgactcaatactttttagaattaacaacataattaacggcgaatttgatcctgatgttacagacgatataagagaattctttaaagaatataaaagcatacgggatttttccggtatgccatattggaaagcggcaacattggtatacggaagccattcaactggtttttctgacacacgttatgaaaaacccgaagaaattcagctgattccagcaggtgagctaaggaatcctgtagttgaacaggtgataaatgaaactctgcagattgcacgtgatatttggataaaatatggaaaacctgacgaaatccatctcgaaatggcccgcgaaatgaaaatgaattcaaacgaaaggcaaaagctgaccaaggccatgcgggatcaacagaaaaaaaatgaagaatatgaagaaatattgaagaaagaatttaacatactgaaaccaagcagaacagacattattcgctatagattatatattgatcagaaacaacgctgcctttatacaggtaaacctattcaaaaaacacagctgtttaacggagaaacggatattgaccatattataccccgccagaggtattttgatgattcatataataacaaagttctatgttttagaaatgtcaacgaggaaaaatccaacatgacgtcctatgaatttatgcagcaaaagggaattgataagtgggaagattttacacgcagagtaaatgaactatacaaagaaggcctaatcagcaaaaagaaaaaaaattacctattatctgatgaaattccgaaagattttattaaccggcagttgaacgaaacaagatacattacacgaagagtaaaagaagaacttgaaaaaatttctccggttgttacaaccgttggcagtattactgattacctaaaggaagactggaaactcaacaaggtgtttaaagaagtccagctcgggcgattcaggtcgattgagaagaaaatagacaaaaaacttattcaggaaatcaggataaacggttatcacgattatcaaattgaaggatgggataaacgaattgatcacagacatcatgcactcgatgctataaccattgcatgcaccaaccgatctatcattcaaacacttaataatctagcccagttatatgaatcttcggaacctatcaaaaataaaatatcacgacattttcctgtaccggcacctgattttcgcgaccaggtaaaaaacactctggaaaccatgattgtatcacataagagcagacgccggcttattaccaaaaaaagagcatattataaagtattagatccttccacaggtgcttatattcttaaaaaacaggaaaaaccatcacctgttgtcagaggacctctgcatgatgaacaacccctgggagaaattaaagaatatcaaaaaataaaaattaaagatgccataaaaaaacttgaagaaaacaaaaacaaccttgataaatttataaatggaaccttccctatagaatggcaaagaaaaaagataaatgaaaaactttctatttataacaacgacccaaaactttttctaaaaaatctaaataaggatgccatacttaatttaaagggagaaaaattggaatatattaccatactggtaagaaaatatgttaagagccgtgatttaaatacctccattacactcagccagattgaaaacattatcgacagaaagctgaaaaatgaaatcaaaaatcatcttaaacaatataataatgatcctaagaaggcatttaccgatgaaggattgatgctttttaatcaaaaccgaaagtttccagtttataaggtgcgctgtaaggttgatgaaagcgaagttgggactttaacaacaagagaacctctcgaaagagatagcgagaataatccaaaactgcatatcgaaaaaggggaaaattatggattcgttatctatgaaaacaaagaaactggtaaaagggaatatgagaccatttcattttatgatgcaatatcattagcccggatgggtttatcaatagttgaagcccgacctggatatagacattgcgtattaaaacataatgaattaatttatgtattaaggccgggtgaagaaaaaaaattgattaattggaatgattataaaaacctcaataaccgcatttatcgtattgtaaaatttacaaataaaaggctttacgccgtcccgcaccaggtggctgagaacatagttcttaatgaagaatatgaaaactttaatgaatttggttcaaataaaaattgtttagaaatcatctctgatgatgaaccaaaaacaaaaatttcagaacgttgtataaagattaatgcagaccgtttaggaaacattaaaccggcaccttgggaaaatgattaa

SEQ ID NO: 53 - DNA, 2919 bp, Environmental metagenome
atgaaaactttgggacttgatttaggcattaagtcggtaggctgggcattaatagaaagcgatgaaaatcgtgaaaattacagaattcttgatttagggataagattgttttcgtcgggacaggctattgagaatggaaaagttgtcggacctcctgcccttccgaggagagaagcaagatcgtccagaagaaccataaggcgcaaaagagcaaggcttatccgcattaaaaaatttttacataattacgggttaataaaaaatattaaagatttgttttataacaataagataacagatgtttgggaactgcgagcattagctcttaatgaaccgttatccccggaagacttctcaaggatattaatccatattgccaagcatagaggctatatgatgtctgttgattctgacgatgatgaaattgacggtgataaagacggtaaaaaagacgataagaaaaaaattaaaaaagcaatagcagaaaccgaaagagcaattaaagaacttaattaccgaacatacggcgaatatgtttacaaaagcgcattagacagcaaaaagcctatgagaaacagaggcggcgaatacaggtatttccccagtaataatttgcttaaaaaagaaattgatattatttttaaaaaacagtttgagttaggtaataaatttgcgacggaagagcttaaaaataagtattgggaaatagcaagctctattaaagattctaagtcgtttgaggatatggtaggcgcctgcactttttttaaagacgaaaaaagagcgcctaaaaactgttattcggcggaaaagtttgttttattaacgtctattttaaatacggttgtcatagacgaagatttaaaagaaattaaaataataaatattaagcatatagatgaaatcattaatttcgcagaaaatgaagacggcgggatttcatacaagaaattaagaaagtttttatctattcccgataccgcaatgtttaaaggtattagttatgaaaagaaaaagaaagccaaaggcaagaaggaaacagacccggaagataaagttttcgtaaacatgtatgggcttaacgctttaaagaaaatctgcggagaaaaaattgcaaaagataaaggattatctcttaaaataatgcgggttttaacctattttaaaggcgtagaacaacgaagaagcaaattattagaaatagaagaattaaacgccgatatggcatctcaattagccaaattagaaaatataaaagaatttgtatctctgtcggctaaagcgattgaaatattgctgccttatatggaaagcgggttaagatacgacgaggcggttaaaacggctcgaatagatggaaaaattccttatgaagaaaatctaaaacaggatttacttcctgctttagacccaaaaacaaacatacgcattaccaatccgactgttttaagaacattatccgaagcgagaaaggttattaacgccgttatcagaaaatacggaaaattggacagagtcaacattgaactcgcaagagatattaaaaccaaaaaagaacgtttaaaagcaatacagactcaaaataaaaatatagagagtaaaaaacaggcggaacagttattaaaagaaaaagatttaaataatccgagtcctaaaaaagacatatctaaaaaagacatattaaaagcaagattgtataaccagcaagacggaataagtctttattcgggggaaccgataaaacttgaaagacttacagaagacggatactgtcagatagaccatatattgccgcgctttaaatctatggataacagctttaataataaagtattgtgtcttgcagaagaaaatcagaataaggctaacgatattccttatgactggctgtcgaaaacagggcagtttgatgagtttaaagcaagggttttgtcgatgaaagataagttaagttatcaaaaggtaaaaagacttttaaccgagaaaatagatgccgaagggtttatagaaagagatttaaacgatacgagatatgcgtcaaggacattaaaaaaatacttagaaacctatttaaaaataggcgaagacgacaataaggtaaaagttttagccgtaaacggctatttaacggcagaattaagacatcagtggggattagaaaaggatagagatgcaaacgatattcaccacgctgttgatgccgtggtaatagctctggcaaacgcaggaattgttaagaaattggcgaattattacaaagaacgcgaatatagaaaacatcctaaatttacagaacctcttgagaattttcgcaaggtgttaaacgaaaaacttgttaatttgccggtaaacaggcttttagtatcaagaccgccgagaaagaaagtaacgggacaggctcataaagaaacggttataagcccgaaaaacaaagaccatagcatgattgaaattcataaaggcaggggatatgcggaacagagtcttatgccgagagttgacgtcttcaaaaagggtggcaagttttattatgttcctatatatgttgccgacttcgctaaaaaagaattgccgaataaaattattacgatagggaaggaaaaaaacgaatggaacgtagcagacgacagttacgagtttttgttttcattatttaaagacgatctgataaagtttaaacagaaaggcaaagcagaggtcatgggatattttttaaatattggtattagtaattgccaaataacatatcaaaatattaacggctcaaaagaaaaaaacagcaaaggaaaagaatttgatccttattttggcggcacaacacttgaatatatcaagaaataccagattgacccgttaggtttttattatgaaatcaaaaaagaacgcagattaccggtttcgatgaagaaaaataattaa

SEQ ID NO: 54 - DNA, 3141 bp, Environmental metagenome
atgaaatattcgctggggcttgacatcggtattacctctgtaggctgggccgtgctgaatctcgataaaaagagagtcgaagctcttggggtgcgaggattcaacgcggcggaagacccaaaaacatgggcatcattagctttgcctcgaaggcttgcacgcagcgctcgccgacgattgcgccgacgggcgggtaggctgcgtagagctcgcgatctctttataaagtacgagctcattcaagcgcaggagattaaatctgcatttgagactgttctagggcaaccatcaccttgggaactcagagcggaaggcctggatagattgctgactgggcaggaatttgcacgggcgctttttcacatcataaaaagacgtggattcaaatcgaaccgcaaggcagcaaaaagttcggaagatggcaaaatgatcgcgggaattgaagccaaccgtgagagaatgcgagagaaaggcttccgaaccgcaggcgagatgtactggagcgatccattctttgatctccgcaagcgcaatacaacagattcatatataaatacagttgatcgtgggctgcttgaagaagaaataaaaacacttttcaagagacaaagagaattaggcagtgtgttcactaagcatgagttcgagaacgcgatattagaagtattctcctggcagaaaccttatgtttcaggcgatgacataataagaatggtcggaacttgcacatttgaaccgaatgaactgagagctccaagatattcctatcatgcggaaagattcttactccttcagaagataaacagcacgacatattccacaaatggcgacaaagagcgatttacccccgaacaacggaaagtgatcgaagggttggcgtataaaaatgtgagagtgacatatgcgcagatacgcaaggcacttgatctaccggaagaagcgcgatttgccgggcttacatacctacgtagaccggaaaaaaaggcagaacttgtagaatcgctggagtgcgagaatactgttttcttcgagcttaagggttatcattctatacagaatgcatgctcggtagatgggatgtgggaccgagtaaagcaaaaccctgaattaatggataaccttgcgacagcgctgacgttttacaagacggatgaggatatagaagagtggctaacggagcgtggagtagagaaggagataatcaacgcggtttccggatgtgagtttacaaaaaccgcaaacctctcgctagtggcaattaaaaagatccttcctcatctggaagaaggtttgcattacagtgaggcatgcgcgaaagcaggctataatcacaccggtttaagcggtgagaaaaagaaagataaattaccatcaataccggtggatatgatcaggaatccagtcgtgctgcgggcgctcagtcaagcccggaaagttgtaaacgcggtaataaatcgttacggctcaccatacgcaatacacatagaatttgcacgtgatatgggcaagagcgcagacaagcgaaaagaagaggagagaagacaaagagaaaacttaaaggaacgagaggaactcgaggaacagttcagagagacattcgatgggcgtgagccgaacggaaccgatatgctaaagtggagactttaccgggagcaaaggggctgttgcgcatattcattgcagcctatcgacctgaatagattgtgtgagcctggttatgtggaggtggaccacattcttccttacagccgcagcttcgataacagcagagcgaacaaggtgcttgtgctgatctcagaaaaccgaaacaagcttaatcggacaccttatgagtatttcgggcacaacgaaaaacgttggtctgaatatgagggatgggtgcgcacgacgataagagacccgagaaaacgtggaaacctgttaagagaaagtttcgaggaaagacaggaagtggagtggaaggatcgcaacttaaatgatacaaggtatgtggcgcgagagtttgcgggattcatccgggcaaatcttctatttgcagacccagataataaactgcctttggtatgtataaatggccaggttgtggcacaggcgaggtggttgtggggactgtataaagaccgtgatgagaacgacctgcaccacgcgcaggatgccgccgtgatagcggctcttttgccttatcagattaagatgataaccgaatactcaaaggttgtcgaaacgagacggaaccatatcgaccctgagacgggcgagataatagaatggaaagagaacgagcgccctcgactgcccgagccgtggaaaggcttccgcaaggaaggagtggagaaattaggtagtattctcgtatcgaggatgccacagcgcaaggtcagtggcgcaatccatgctgatacgataaggtcggcaaagcatatcagcacggatcgcgtaagtgttgtaaagaaaccgcttaattcgctctccgagaatgatttgaaaaatctgttcgacaccgagcataataaacttctatattcagctataaggcagagaatggctgagtttgacaataaggcgcaaaaagcttttgccgagccacttttcaagccactcagggacggcagcccgggcccaatggtacgcagtgtgaaggtatgccaggcgcagtatacaggcgtgaacgtacgcggtgggatagcagataacggcgatatggtgcgcacggatgtgtttagaaagcagaacaaaaagggaaaatgggaatactacctcatccctgtttatactgttgatatgataagtgggaaactgccggataaagctatcgcggcacacaagccttacaatgaatggcccgtgatagataatgaatacgaatttcttttcacactgtatccgtatgacttgatacgcgtagaaactaaggatgggggaggactttattactatagatcaagccacagagccaacggttcacttatcgtttgcaatgtcaacaaagcggacactacatttggcattggtagtcgaactgctatttcaatagaaaaattagaaatgggtgtattgggcgactactttcctgttcacaaggagataagacgtggcctggagaacggtagtcatctcgaacccgacaagattgagagttga

SEQ ID NO: 55 - DNA, 3285 bp, Environmental metagenome
atgacggttcgctacaggctcggtctcgatctggggacgaactcgataggctgggcggcagtcgcgctcgacgccgaagggcgcccaggacggctcctggatggcggcgtgcgcatcattacgccgaatgatgaggctggacgagatcccaagtcgaaggcgtcgctggcagccgggcgacgtgccgcgcgggcgatgcggaggcgacgcgacaggttcctgcgtcgtcagaagcgcctgatggaaatacttaccgcaaacggattgatgcctgctgacacagcggcgcgtaaggagctggagaagctggacccctactggcttcgggcgcgcgcgctcgccgagccgctcacacttcacgagattggacgtgctctgttccacctcaaccagcggcgcggtttcagctccaatcgcatcactgatgccgatgacgcggaagggggcgccatgaagcagggcatggcgcagcttcaagaggccttggaacaggcgggggcgcgcacgctcggagagttcctcgccaagcggcaccgccgagaccgcgagggttatcgggtcgacccgtcaggccagcggatcagcaaggcgaacggcaatgatcgcgaggcgtcgaaaggggtaaggttccgcccccacgcagagggcagcaaactgctctacgacttctatccgacgcgggacatggtcgcccatgaactgcggcaggtatgggtagagcaggcaaagacgcataccgagttgaccgagcccctccgtgaacagctcgaacacgtcattatcgcccaacgcccgctcaagaagccccgtgtcgggcgctgcacattcaggccggatgaagagcgggcgccgcgcgccttgccgctgttccagcgctttcgcatcctctccgagctggcggctctcgaaatcgaacgtccgggcagaccggcccgaaagctcaccatccccgagcgcgacctgctcgccaatcttctcgggagccagacgagcccggtgagcttcacgaagatggcgaaagcactgaagctgcccgatgacgccgatttcaacctcgctcgtggtggtcggaagggtctcgatccggacaagaccgctgcgatcctcgccaagaccgggaagggggagagtttcggcaagggctggcgcagtatcccgttcgaccggcaatcggaaatcgtccagcgcctcctcaatgaacccgacgaagatgcgctgatcagcttcctcattgaggagtgcgatctctccgatgagcaggcgcaggccgcatcttccgcgcgattgccgcaggggcacggacatatcgggcccagcatgctggaggagcttgtcgacgtcctccagaacgacagcgtcgaggtggtcgatccacagaccggggagatcctcccgcgaccgcttacatacgatcaggcagtggtgcgcctcggcagtcaccactcacatttcacgggcgagcgccgggagcgtctcccgtattatggcgaggtgctcgcccgccacgtcatcgccaaccccgatgcaccggaaggcagtcaggaacgaatcggacgcgtgccgaacccgaccgtccacattgccctcaaccagacggccaagctggtcaacgccctcatcgaggcccacggtcgccccgatgaaatcgtgatcgaactggcccgcgagctcaagcagaaccggcagcagaaagacgaggcgatccgccagaaccggagcaacgaaacggagcgcgcgcggatgcgcgaggaactcgcttcccttggctatgccgacacgccgggaaacatgttgctcctgcgcctctatttcgagcttccgcccgatgagcgggtttgcgtctattcaggcgaaccgatctcgaaggaaatgctcttctccggtgccgtcgatatcgatcacatcctgccgcgctccaagacgctcgatgacggcttcgccaacaaggtgctgtgcacccgcgagatgaaccgccgcaagggcaatcgtgcgccggctgatgcctggagcgcggaggagctgctcatcattcacgagcgatcgaagcgcctgttcccccggaaggcatggcgcttcgctccggatgcaatggagaaatacgcggagaacaacgacttcctcgcccggcacctcactgatagccagcacatggcgcgactggcgaagacatatctcggaaccctctatggagaagacgccgcaaaacgcgtctggtcgacaccggggcgcctcaccgcaatgcttcgcgggatgtgggggcttaacggtctgctgaaagaccataatcgcgccggcgcggatggcgctgatgtgaagaaccgcgacgaccatcggcaccacttccttgatgccttcgtcgtcgcctgcacggatcgcggcacgcttcagagagtggcaacggcatcagcgcgcgcggaggcgatggagatcgaccgctgggccgaaaagggcgcgtttccagagccgttcgagggttatcgcgagcagatctccgaccgcatcggaaccatggtcgtttcgcacaagcccgatcacggcattacgcccgggcgcgcccgcgagagacaggcgaccagtggccagcttcacgaggatacggcctatggccgggttgatgaacaagtcaacggcaagacctacaatctcgttacccgcaagccgattggtgctttgacgaagaatgaaatcgggcaggtccgcgatgttcgcattcgcgaggcgcttcaggaagtcgcctacgaggccgaccgggacgggatcaagctcggggaagcactcgcccgcttcggggaagagaacggcatccggcgcgtgcgcgtgttgaagactgacaagaccgccattgccctgacgcacggcgatggccgcttccacaagacctatgtgcccggcgacaaccaccggctggagatcttcgtcgcaccggatgggaactggaccggcgaagcggttacggtcttcgatgccaaccgcaaggactttacccccgcatggcaaagcatgacgccccggcccgcattgatcatgcgtctgcacaaaggtgatctcttggaggcggatttcggcgaggggcgatgcatctggcgggtggtgcgacttgaaccgtcagccaagcgcgtccgccttgtccgagatttcgatgcgggtgcatacgaggagcgccataaagacgcagaagaccccttccgctggaactttgccagctacgcgcgccttcaggcggcagcggctacacgtgtgcgcgttgatccgatcggcagggtgcttcccgcgcgagagcactga

SEQ ID NO: 56 - DNA, 3114 bp, Environmental metagenome
atggcgttgatctttgccttcgatataggtaccacgtctattggctcggccgtcatcaatcatgatcctggccgcaagatcggtaaaatcttgcgcttgggtgtgaggatttttcccgagactcgagaaccgaagaccaatgcgcctctgaatcagcagcgacgagccaagcgcatgatgcgacgtcaactcagacgccgtcgcgctcgtcgacgcaccctgaatgaagcactgagtagcgctggcttgcttccagcttttggcacgtcgcaatgggatcggctcatgaggctggacccttacgatctgaggagccggggcttgactgaggcgttagagcccgaggaattcggacgtgccatttaccacttggcgcaaagacggcattttcgaggccgggacatcgagtcagagagcgaagatgacaatgcagattcagaggagcttgctgctcgcgctgaagccaaggacatgcttgcgacattgcgccaatcaggtatgaccttgggtcaatggctgaaccagattgaatccggaaagcgcaaacgaggtatccatgccgcaagatcgaccgttgaagacgagtttgaacggctttgggcggctcaggaagcccataacgataaactcaaggatcccgaattccagagttctattcgcaagataattttctatcaaagaccagtattctggcggcagaacactctcggttcgtgccccctgattcctggtgccgaactgtgccccaaaggttcctggctttccatgcagcgaagaatgctggaaaagctgaataaccttgagcttgttggagcgggtgcaagaaagctggaccctgaggaacgcatggctatcctcgagtcactgcaatcacaagccagcatgagctgggccggcgttcgaaaagcgctcagttccatctatcgaaatcgcaatctcaccggagaagagaagcgccttaaattcaaccttgagattggtggcgagaaaggcttgatcggcaaccctctggagcaacgcatcgccgcaatcgttggcaagtcatggtcagctcatccacacaagcagaaaatccgtgaggcgctccatgaacgcctgtggaaagccgactatcggaaaattggcacccagcgtgttgtcattcaacctcaaaagaaaagaaggcttgatcgactgaacgcagccgaaagtatcgtcaaggaattcgaacttccaggagatctgatccaaccgatttcagaaatcagctttccgtcgggctgggaaccctattcaattgacgctttgttacgaataattccggaactagaaaatgggacacgatttggtgaattgcttgtcgggcccgaactcgaagactggagaaccaagacctttccggatcgcattcgacccaccggtcaaataagtgatcgcctgcctagtcccagcgatccggatgagaatcgccgccttcgttccatccgtaatccgacggtggtgcgctgtcagaatgaattgagaaaagtggtcaacaacctgatcgatgtctacggtaagcccgatatcatacgtgtcgagctagcacgtgacgtagggcgatcaaaacgcgatcgagaagagtttcagcgggtcattcgccagcgggaaaccgagagaaaagcagccattcgtgatctggagacaaatggcatcgtccaaccgtcgagatctgatattgaaaagtggctgctgtggaaagaatccggccagatatgtccgtacaccggcgatgccatcggatttgatgatctattccgtacaggccgattcgaggtggagcatatctggccccggtctcgctgtctcgacgatagttttgcaaacaagaccttgtgccgttcggatatcaacaaggagaaggggaatcgaacgccctacgagcatttgggcagcaatactgatcaatggcacagaatgcaggatcgcctcaaaggcatggtcagaaagggaaaaaagcccggcatggccttcagcaagaccaaacgctttctggccaaggagattccggatgatttcacacacaggatgctcaacgataccagttatgccgctcgggaatcggtaaacatgctcaagcaactgtggccgcaaggaggagcgaatatgccggtgactgtgcaggtggtctctggacgtgtaactgcccaactcaggcgactatggggcttgaataatctactgcacgatggtgccgaaaaaactcgggcagatcatcgccatcatgcagtcgatgccctggtagtcgccagttgcaatcctggaatcacccagtcactatcgcgctactggaaattgcgcgaaagcccttcggccgaaactcacccgatcccattgccctggcccgaaatccggcaggatgcaacccaggcactggataaagtcattgtctctcaccgagtcagccgaaaactttccggaccgctacatgaggaaacccattttggcgacacagggctcgaagcggttcgccgggggaccatctatcggcaatatgtccgtcgcaagccgctgcacgaactcagccccaaagaactggattgcatccgggatccggcggttcaatccattgttcgtaagtgggttaacgcccgaggcggcgaccccaagaaggctttttctgacggctatcctaaattgggcaccaacggcccggagatcaaaaaggtgcgcttggtggttgaaaagcgccccgagcttacaattcatacaggcagcggagtcgtcgacaaaggaaagaaccaccatctggcagtttatcggaatgaagaaggtaagctactttttcgtattgttagcctcaatgaggcgaggacagctcttgccgagttgggtcatccggtcgcaaaaactgaagccagtgcaaagctactgttttccctctctgccggggattgcctttccattcccgacggcgatgaaacaaagctctggatcgtaagtagcacttgggcagagggccgagtgaccatctcggaaactcacgatgccgcgggccaaacaaaaaccaatccctcaatacttgctctagtcagaaagggtgcacttaaggtgagcgtcgaccccattggtcgggtccggccagcacgggattag

SEQ ID NO: 57 - DNA, 4578 bp, Environmental metagenome
atgacgaaaattttaggacttgaccttggaaccaacagtattggatgggctgttgtagataaagaaaataataaaattgataattgtggcgtaagaatttttcctgaaggcgttgtgaatatgaatgagggtgaagaaagagaaaaatcaaaaaatgccctgagaagagaaaacagacaaaccagacgacaggttgcccgccggagaatgcgtaaaattaaactacttgaactacttattgaacagggtatgtgtccattaaccaatgagcagttaatgatttggaaacattgggataaaaataagaaaagtgaaggtagacactttccacatacaaaagaatttattgaatggttaagattaaacccgtatgaattaaggtacaaaggaattaacggtgagctcacaaaaatggaatttggtcgatttttgtaccatattattcaacgtcggggctttttaagcactcgcaaagaaaaagagactggaaaaatctacgctggtaaagaaaatatggtaggtattgatgataccaaaacggaattgaatgggaatactcttggagaatatctatatactatttaccctgaagaaaatgaatcttataagaatatccaaaatgaagaaggagaggacgtaaggataagaggacgatatactttaagggatatgtatgttgaagagttcgaaaaaatatggcaaaatcaggcctcaaggcttggactggataaggtttctgtaattaagcagaaagttgtttttcttaacggaagtaaagatcgtaatcgaaatgcaaagaaaataaagtatcttaaaaataacagagataaaattgaggttcaggaaattattgttgaaagagagaaagctaataaaacattaacacgcgtaacctcttatgaaaatatacctctgcatgaccatctgggaggaaatattgaaatatcagatgataaaatcaagtttgataataaagatagtgtgttattttatcagcgcccattgcgctctcaaaaaagtttacttggaaaatgccgttacgaaaaaaataaaacacctgtttctgtttctcatcccgactatgagctattcagggcatggcagtatgttaatactataaagtttgggaataatattccattaccaattgagcagaaaagtgcgattgttgaatttctcagaacaaaaaaaacatcagtcaaatttgctgatatagttaagttgcttaatatgtcgcatgaaaattttaattataattatgatgataaagtagaaggatgcccaagcattgctcaattaagtaagctttttagtaatgaaggttgggagaacaactatcacaacatttggcatgatttctacttttttgacgattccgaaaagctttttaaaaagttagctaacacaaaagaatataagatgaagaatgtcatcaagattgatgatattaaaaaagtaagtattaaagacgataaatatgccagtttatcactaaaagctgttcgtaacattttaccatttttgcagcgcggtttaatgtataatcaggcagtatttttggggggagtaatgaatgcttttaattataaagccctgagcgatgaaatagccagatgggataggtttgctgattatcacgatacgattataaaagatatactctcaattattaaagaaagaaataaagaaggagaagcaatacaaaaagtcaaagaatatctttctgatcctgctaatcattatggttttgagaaagaatctcctgcctttaaaaaactgtaccaccatagccaggaaattgaagagaaggaaatgtcggataaattatctgaaatagaaaacctgagaaatcccattgttcagcgagccatacaagaaatgagaagaatgataaacgagttaattgagaagtacggaaagtttgatcgaatagctgtagaaatggggagggaaatgaaattaagtaaaaaaggccggcaaaatgtatcccgcatgatacatcaaaattttgaagcaaacgagaatgttcgagaaattctaaaagattatcagcttgcaccttccaggcaaaatatacaaaaagtgcttttgtttaacgagatacaggaaaaagcaggcaaagttgtttgcccgtatagtggtagaacattaaacattagcgatttgctgggttcagaaaataaagttcagatcgaacatatcattcccagaagtttttcgcaggatgatagttttacaaataagacaatttgtgatgcaaaatttaatcagttaaaaggtaatctgactccttatcagttttatcaacaaaataacaacaaaacattatggggtgctgcaacttgggaagaggttgaacaaagagcttacagtgttttaccttttaataaagccaaacgttttactacccgaaagacggaatggaaaaccgaagaatttatttcacgtcagttgaatgacgaccgttacattagtaaaaagaccaaggaaattctttctgaagtttgtaatgaaattctcgtaatgccgggtgctgtaactgccgacttaagaagattatgggggttaaataatattctgcaaccaacaatcggtttacccgatgatgaatttaatatagatcgtgaaaaagatattaactactgggctgtaaccgacgagaatcgaaagatcaaaaaactatacccgatgaacaacctaaggccggatgctgctgccgaagaaactgttgtcgctggatatgtaacaaaaaataaattcaaagcgcaaaggcttaatcttgaatttgacgcaccggatatttctgatggcaaatactatgtgaagttccatgtatcaaaaccagtaaaaacactgcgtcaatatgtcgataaaccggagtacggagagaacgagattattttaagaggtgtgattaaccggaataaatttaatcatgatagtttgaaacgtaaaattgacgctccaaaaaacattgatgatggcagttattgggcaaaatttaaaatagtggataaaagatttgaagaacctgaaaaaaacaaacggcctgaaaataaaaacggaatatgtcttttcggcaaagtgaaggacaatgttttcacatcttacatttaccagtgtgaaaccaatttagaagatggacattactgggtgctacttgatttagattttgagcatgttgaatttgttgctactaaaaacgagaaacctgatatcgaaaataatcaattattagttttaggcgatctaaaccaggaaggaacttttactgcattgcacgatatacagttgcaatttgactggaatgataaaccgggacgatactgggctgtattaaatatattaccggatattcctgaatttaccgctgttgaaaatgaaccgcctgaaattgaagatgatgagaaattaattgaaggaaaaatatgggtggatcacaaaaccggtgaaattcgttttgacccgaaaaagaatagagacgaccataggcatcatgctgttgatgcaattacaatcgcgctaacagactataataatatcaatcagttaaactggtataatgctcaaaaagataaattggagaaaggaatccctactgaaaggccttcttttgacgaaccttgggagaattttttcagtgatgccagagaagctgcaggcaaaatattggtttcacaccataaagacaataccgttacaaaaaaagtaaccatgattattgagaaaaatggcaaaaaattcagaagtgaaggtcaggccgtacggggacaattacataaagaaacggtttatggtaaaaggacgcctccaagagcagagcaagcatttcatgtgcgtaaaccaatagaatcattaaatgacaagcaactggataaaattgttgacgacaatgttagaagcattgttaaatatgggcgcgaaagagaaaaatttattaaagaacaaattaaagcgttacaaaaagatcgaacaaaagctggagatgaagaagaaaagaaaattgatcagcaaattaaatcgctcgaagaagaaaaccgccaattgtatacactcccgaataaaaatggagacagagtgccaataaaaaaggttcgtatcagggagaatcttggaaatacggagatgttaaaaccttcagaaaatataaaccaatatgttaatccaaggaataatcatcatgttatgatttataaagatagcgatgggcaattaaaggaaagtattgtaaccctctgggaggcagcagaacgaaaaaatcagggaaattcggtttatcagttaccaccggatgggctggaagttgtttcaacgttagcagtcaacgatatgttcttattgggtctggaaacagagcaaaataaggatatcaaaaagctggattatcaaatcttgagtaagcatctatacagagttcaaaaactgtcgagtatgtattatacattcaggcatcatctggcaagtactgtaacaaattccgatgaagaatttagtattagaagttttggaacttgggaaaaagtgaatccaattagagttaaggttaaccagataggtgaagtaatcaggtctttataa

SEQ ID NO: 58 - DNA, 2937 bp, Environmental metagenome
atgtcaaaaatgattttaggacttgatttagggattacttctataggctgggcactcgtaaatgttgatgatgaagatgctcaaaacaacaaaataattgatagcggtgtgcgaattttcacaatagccgaacacccaaaagacggcaaatcactagcacttccaagacgagaagctagaggagcgaggcgaactaccaaaagaaaagctcaaaagataaaagccgttaaaaggttgctcataaaagaaaaagtagtaacagcgaatgagcttaacaatctttttatcggcaataaaaaacaaaaagatgtttgggatttaaggcgagaggctctttatagagaactaaacaataaagagttcgcccgcataatggtgcacttagcaaaacatagagggtacgcttcaaaccgtaaaagcgaagagcctacagatagtgaagggaaagccgttctgtctggaattacgcacaacaaaacaattcttcaagaaaaaagctatttaacaataggcgagtatatttccacaaaaaccaaaaaaagaaatggaaaagatacagaaggtaaactcaactatgaaaattctgtctctagagagatgctcataaacgagataacgactatctttgaaagacaaaaagaattttcaaatccacatgccaaagaggaactactagaggagtataaaaacatagcctttactcaaagagctttaaaatctgtcgaaggtatggtagcgaactgcccttttgaaacaaacaaaaaaagagcacccaaagcaagttcaacttttgagacttttagagccttacaaaaactaaaaaatcttagaatgattagcaatgagggtgaaagtgctctcacaaaagagcagatactccaagcaatacaaaaggcaaaaaccgcaaaaagctttacttacaaaacactcaaaactctttttgctcttccaaaagaggttcaatttaaagggcttacctattttgaccacaaaacgggagaggcaaaagagcctgagagtgcaaaacttttagattttagtgcttaccaaaaaattaaagatgccattcaaagcagtgataatctatactggaacaaaatagaagagagtgttaatcttcttgatgagattgcgaaaatcttaagcacacacaaagatgacaaaaaaagcttagaggagctaaacaaaattattgataatccatctgtttgtaacgctctaataagcttgtctttttcaggtttcggacatataagtgtagaagctatgcgcaaaataaatccatatcttttagagggtatcgattatgataaagcctgtgaaatggcagggtatgattttaaagctatatttaaaggggacaaatcaacgcttcttccacctcttagcgaacaggaaaacttagaaatgacaaaccctgtcgtcaagcgcgctattgcacagatgcgtcttgtttataacgccataacaagaaaatacggtgcaattgatgccgtgcatgtggaatttacaagagatattaaaaaatcacataaagacagaaacgacataaaaaaatcgcaagaggagtttcaagcactcaaagaagaggcaaaagctgaagccataaaaatattaggcaaagagccaagtgcaaaggagctactcaaattcagactttggaaagagcaaaatggagagtgtatttatagtggagcttacataagcccttctattttagccgacccttatgcaacagaagttgaccatattctcccatacagtcgctctcttgatgattcgcttaataacaaagttttatgcctcacaaagcaaaatcaagacaaaggcaacaaaaccccttttgagtattttggagcagacaaagattctaaagaatggcaagaatttacaggaagagtagaaggtttaaaaaatattaagggtgccaaaaagggcagactcactaaaactaatttcgacgagagtagtgaaaatgcttttaaagagagaaacaaaaacgatacttcgtacatctcaaaatttgtaaagaactatatagaatcgcatgtggaatttaaagagtcaaaaatgaagcgccatgtctataccatgaatggcatgctcacctcacaacttcgctacaaatggggcgtaggcgataaaaacagagaaaatcatttacaccatgcggaagatgctatcatcctcgcttttgcaacgcaagcacaagtacaaaaactctcgacaacttcggcaaaaagagagggttttagttttaaaaacaaagaggaaaaagcaaaagagctaagatttgaaccgccgatggagaactttaacgaaaaagtcaaagaaagcattgaaaatatttttgtttcccacatgccaagacgaaaggtaagtggctcggcacataaagagacagtctacagcaataaaacacatagcgtgaaaaaagcagacggaaaagtagagtacctcaaaggcaacagcgtaaacaacaatgtcaaactcaaacatggcatagccctcaacgactcaatgccaagagtagatttgttccaaaacaaaaaaacaaacaaatactatcttgtaccaatctatgtaagtgactttgttcaagaaactctgccaaacaaagcgattgtagcgggcaacaaaccgtggttggagatggatgaggagtatgagtttaaattctctttttataaaagcgacctcatcgaagtcaaaacgaagaaaactgcaacaaaagagtctgttcaggttctggggtattttaatacggctgtaagttcaactgctcaagtagttattgatacacatgatggaaatgaagaatatagatatggcacccaaaatcttatctttgttaaaaaatatcaagtagatgcactaggaaattacatagaagtcaaaaacgaaaaacgacaaggaaccaaaaaacaaaacagataa

SEQ ID NO: 59 - DNA, 3114 bp, Environmental metagenome
atgttcggaaaaatgcgttatcggcttgcactcgacttgggctcaacctcactcggctgggcaatggttcgtctcgataaggaaaatcaaccctgcgcagtcatcaaggcaggcgcccgaatcttttctgatggccgtaacccaaaggatggttcatcgctggcagtcacgcgccgagctgcacgcgccatgcgccgccgtcgcgatcgtctgctgaagcgcaaacagcgcatgatggatgcgctcatcaagcatggtttttttccagccactgcagccgaacgaaaagcactggaaacattgaatccctacgcgctgcgcgcaaaaggtctggacaaagcgctgacgcccgcagaattcgcccgcgccctgttccatatcaaccagcggcgaggcttcaagagcaaccgcaaaacagacaagaaagagaacgacagcggcgcactgaaaacagcgatccagaagcttcgcgaaagcctacagggggaaaactgccgcaccgtaggcgaatggctgaacaagcgtgacaattccggccaaacagtacgggcgcgctacagacaggagaagcacatcaaggaggatggcaaatccaaaatcgacaagtactacgatctctatatcgaccgcgccatgatcgaacatgagttcgatgaactctggagtaaacaggccgagcttgaccccgcacgattcaatgagaccgcccgtgctgaattaaaagacatcctgctgcaccagcgccccctcaagcccgtcaagccaggccgctgcaccttcctgccggaagaagagcgcgccccgctggcactgcccagcacacagcgattccgcatgtatcaggaagtgaacaacctgcgcatcctgcgcgatggattaaaggaggaacctctgacgctggaacaacgcgacacgctgatttttgcactggaagagaacaacaaatgctccttcacaagaatcaagaaattgcttggcttgagcggtgcagttcagttcaacttcgaagacccgaagcggcaggaactcaaaggaaacaccaccagcgccatcttggggaaaaaggatttgttcggcccggactggttcaagttcgatgaaaccaagcaggatgccatcgtgatgaaactgctcacggaggaaagcgaagagacacttgttcgctggctgcaaaatgaaacgggagttgatgaaaagactgccgaggccattgccaacgctggcctgccggaaggctatggcagtctgagcgcccaggctctggctcgcatcctgccggagctgcgccgcgacgttgtgacctatgacaaagccgtcaaagccgccggtttcgaacatcacagcaaacttggctccgataccgagatccctagcatcaccttcaaaacagagagaattgacctagacactggcgagataaaggcattccacatccacgacaagctgccctactacggcgaatacctgcaacgccacgtcggattcggcagtggcaagccggaagacactccggagaagcgatacgggaagatcaccaacccgactgtccatatcggtttgaatcaggtgcgactggttgtgaatgcacttatccagcgttacggccacccaagcgaagtaatcgtagaagttgcccgcgaactgaaacagaaccatgagcaacgcaaggaagagagcaagcgacaggcagagaatcaagatcgcaacaaacgactgcgcagcaacatagcaggcattcttaaaatcagcgaggagcaagtcagccgggacgatattgaaaaaatgatcttgtgggaagaactcagccatgacgtggccgatagaaagtgtccgtattctggcgtcccgatcagcgcttccatgctactcagctcagaggttgagatcgaacacatccttcccttctctcaaactttggacgacagccttaataacaagaccgtctccatgcgccaagccaatcgaatcaaaggcaaccgcacaccatgggaagcaaaacaggattttgaagcgcaaggctggaagtttgatgacatcctcgcaagggcaggaaacatgaagaaggagaagcgctatcgcttcgccgaggatggatacaagcgctggctgaaagacgatgcgggcttcctaccgcgtgcattgaacgatacccgccacttgagcaaggtagcacgcgaatacctgaccctgatctgcccgcaagccacgcgcgtcatccccggtcgcatgaccgccatgctgcgcgggaagttcggcctgaatgacgtgctgggactgaatggcgaaaagaaccgcaatgatcaccgccatcatgccgtggatgcctgcgtcatcgccgtaaccgatcaaggtttgctacaacgcttcgccaaagccagcgccagcgcacgcgagaagcaactgaacagactggttgagagcatgccactgccgtgggagaactaccgcgagcatgtgcaacgggctgttggaaatatcttggtcagccacaagccggatcacagccatgagggcgcgatgcacaacgacacagcctatggccttcgcgatggaggcaaggtcagcttccacaaaatggtggacggaaaacgcgagcgcacagaagaaagcctaaaggtcattaagatcagcgatgcgaaggccattgaacggcacggcgtccttccaacgggcgaaccaaagccctacaaaggctacaagggcgacagcaactattgcatcgagatagttagaaatgaaaaaggtaaatgggaaggggaagtgatatccacctttgatgcttaccagctggtgagacagcatggcatagagcggttgcggcacccctcgttaagcgtttccggaaaaccattagcaatgcggctcatgaagaatgattgcgtcaaactccaactagacaatgaaattattacttcgcgagtttgctgggttagaactgacacccgaattgcctttgcacctgtaagtgaggcaaacgttgacgcacgtgatcgagacaaaggagatcagtttagctacataattaaaactgcaagcgttctacaaaaattatgcgcccgccaaataactataacccccatcggcgagcttcacgatccaggcttcaaggtgtaa

SEQ ID NO: 60 - DNA, 3087 bp, Environmental metagenome
atgcgtatctggggcttcgacgtcggaaccacctccatcggcttcgccgtcatcgactacgattccgaccggaaggctggccgcatcgaacggctgggcgtccgcatctttccggagggggtgaccgaagacaaaggcgaaccgcgtaacgcccagcggcgcgccaagcggatgatgcgccggcaattgcgacgtaagcgctggcgccggcgggcactgcatgaaatcctggctgaagccggactgctccctaccgacgatccgaaacagtggcccgcagaactggcgcaggccgatccttatgacctacgcgaccggggcttgagccagaagttatcaccgcacgaagtaggccgagccctcttccatatactcaagcggcgcggcttccagtcggcccgtatcgcggccgtcgagccatctgacccggccaaggagaaagaagacgaaggcatcaaggcagaaatcagccagattgccgccgagctgcaaggacgtacgttgggccagtggctgaagtcccagagcaaacgccgcgggcaccatacggcacggaccatgacgcaggaagagttcgagcgtttctggacggctcaagtcaaatatcatcccgacttgcttaccgacaatcttagggctgccctggctgaaacggccttccggcaacgtccgattttctggcgcctcaagaccctcggaacttgcctgctagaaaaggacgcaccgctttgcccgaagggcgcctggattggtcagcgcttcgaaatgctgcagacgctgaacaatttgcgattggcaggtggcaatgcccgccccctggacgaggatgaacgcaggctgctattggcggcattggaaacctccccgtccctttccttcccagctgcgcgcaaactgttgaagccggtctggcaacgcaatggcacatcgctcaaaacaaagttcaatttcgaggttgaaggcggcaagaaggctttgcccggcaatgcgctggaagcggcattgatcgacgcctttggcgaagcctggaatacgcaccccaaaaaagacgccatccgtgcggaactgcaagatcggctctgggcgatccaatacagaaagctgggcgagaagcgagtggaaatccgtgacggcaactccgccgaagccgaacgtcagcgcttcattgcgttcgcacaagcggaatggaacgccagccgaaaaaccgccgaaaccctgtcccgtatcgagccgccggctgcctggttacgccattcgatcaaggccatccaaaaattgctgcctcatatggaggccggcctcacctatgccgaggcccgcaagctcgtttacccggagcaattcgaaaaatcggaccccatagaaaagctgccgtcggatccgcggcaattcgaggatctgcgcaatcctacggtgaaacgtgccctgaccgaacttcgcaaggtcgtcaataacctgctcgcgacttatggcaaaccggagcgcattcgcatcgagcttgcccgcaacgtcgcgctgaccggtaaagataaagcgaattacatgcggacgcttgccgagcgcgaacggcagcgcaagcaggctgccaaggaactaaaggcatcccttggccgcgaacctaccgcaggcgatattgaaaaatggctgttatggcaggaatgcgaaaagacctgcccctacactttcgatagcatcggatttgccgacttattcggcaacatgccgcgatatgacatcgagcatatttggccgcgctcgttgagtctggacgattcctttgcgaacaagaccctttgccgacgtgacgtgaataacaagaaaggacaacggactcctttcgagctttacgccagcaatcatggcatagccgatctgccggactgggaagaagtgaagattcacctgcgcaataaggtggatgctggacatttccccgagagcaagtggaaacgcttcacgcgagagcaacctttcgcagcggcagacgacagaagcgacgaccggttgatcggcgataccgcttacattgcccgggaggcacgggcgtggctcggccaattgatgccgcgcggaattttcgacgtcgaaccgcgcaatggccgcatcgtgtcgcgtttgcgcaaattatggcatctggatcgcctgctcggcgaagacggaaggaaaaatcgcgacgatcaccgccatcatgccctcgatgctgcagtgaccgccctattcgatacccgggcgatgcaggacatcgtccgctggtataaagcgcaagaagaccgccccgaagaaaagccgccggcaatcgacctgccctggccggccttccgcgacgatctgcgtacggcgctggaggctatcgtcgtatcgcatcgcgttcgccgtaaggtgaatggaccgctgcatgacgaaacccggcttggcgatagcggcgagccgccaatacgcgaaggcggcaaggaatatcgcttctatgtcaaacgcaaagccttagcgcagatgagcaagggcgaaatagacgcgatacgcgacgagcgtatccgcacgctggcgcaagaacggctggccgcccatgacggcgatgtcaagaaagccttcgcgacaccgctcatgctacctggcagagctggaaaaccggatcgcgaggtcaagaaggccagagttattgtgaaatcgcaacctcatcttgtgaccgccctaaacggtggaaaagcctacgccgcggccagtgataaccatcacatggcgatctatcggtccattgacggaaaagtaagttacagaactgtcagccggatagaagcagcacgccgcactgctaggaaagagcccgtcgttcagcgagttctgccagatggcgcgcaactccttttcaccctaacaccaggcacaacactggcatttcccaacaacaacggccggccaatctatcgtgttgtgaccagcgtctgggactcagggcaaatagtcttggtggatcataccgaggctggagggacggtttggaaaaggcccaatgcgtcgagcttagtggctatgggggcaaaaaaagtttccgtcgaccccatcggccgggtcaggccggcccgcgattga

SEQ ID NO: 61 - DNA, 3027 bp, Environmental metagenome
gtgcttggattggatatcggaactaactcgatagggtgggccctcatcgatacggatccgaccactggacgagccgtaggcatccgtgattgcggtgtacggatctttcaggaagccgtcgatgcgaagactaggaccccgaagaatgctgcgcgacgttcggcacgcttgctgaggcgcctgctagcgaggcgtgctagacgcaaacgcaagctgatgaacctgcttatcaagtacggacttttgcccccagagattgcagccgatgatgcgaaaccggagatcatcctaaacgcattgggtgatccgtacgagctgcgcacgaaggcgctcgatgagccattgcagccctacgagcttggaagagtcctcctgcacctgtgcgcccgacgcggctttctgtcaaatcgaaaagcacacctggttgcctatttggcggaggagttctcggattatctggcgcagatcgatgacaccgacgatgcagcaaactccagcgctagcacggaggatctaggaaaggtcaaggatggcataaagaaactgtcggaggagattcacgtatctgggtgccggacgctgggcgagtacctctatcgattggataggcacacacgcaagcgggctagattcacgagtcgccaaatgtatctcgacgagttcgagatgatctgggaatcgcaggcacgatacaaccctattctcacggatgatctgaagatccaagtgcatcaggtcatcttcttccaaagacctctgaagtcacagaagtccctggtgggtaagtgtctcctcgagccgggtcgtaagcgcacggccaaagcacgcctggaggcgcagcagtttcgaatctggcaggacatcaatcacatagagattcagaatccagaaaccagagcgtggcgccgtctcacgcaggaagagcgccaaaagctgtttcatgcgttacacgagaagaagtcgctcagttggagtggggtccgcaagctgctcggaattcacaggggagagcgtatcaacttggaggaggcaaaagacaagctgattggcaatctcacctggatagagctttcagaagcgttgggagatcgatggagtcgcatgagtgacacggagcgccagtcgctggtggaggatctgctcacgatttccgatttgacggctcgtgcccgcagactgcgcgagcattggaaactcagtagagaagaacagtacctgttgtgtacctgggagccgcaacccggctataccaatcattctttgaaggccattcgggcgatgttgccgtacttggagcgtggcgcaatctactctgaggcgcggcaggcggcaggctacaagtacgaggttcttcagcttaataagccgctgctgggtgagccgccctacgtgcgcaatcctgtggcccagaaagcgctctatcaggtgcgccgtgtcgtcaatgccgtcattcgtcgctacggcaagcctgcgcagatcatcgtcgagctggctcgagaaatgaagctgtcgaaaaagcaaaaaaaggccctcaacaaacaaaacaagcgcaaccgcgaggcgaaccaggaagcggctgagcaagttatccgtataacgggcgtcgagcatcctagctacgatgacaagctgaagtaccgtctttggaaggaatgtggtggcgtttgtccgtataccggcaaggccatcagtttacacgagctgttctcagacgcggtcgatatcgagcacatcctcccgtatcaccggacgctcgatgatagctacatgaataagacgatctgctgggcggatttcaaccgcaacgtcaagagaaatcaaacgccgtgggaggtgcttggtggcgatgcggacgcatggggacaattgctacagcgcattagatcgtggccgaaagccaagcgagaccggatggagcgaaggtcgctggatgggatcgaggactttatcaacaggcagctcaacgatacgcgactaatctgccgcgagacgctcggttatctgaaagagctgggggtagaggtatgtgtgtcacgcggcgcgctgacggccgacctgcgccatcattggggactgaacgcgttgctctccagcagcgaagacgaaaaggaacgaagagatcacagacaccacgcggtcgatgctcttgtgattgcattgacgacgcggcgccttttacagacgctttcggagctgtcgtcgaaacagggctcgcggtcgttaaaggatcgtctccgggtagggcttccttggccaagcttcagagaggatgcgaaactagcgatagagaagatcgtcgtgtcacacgcggcggcacggaagatcgcgggcgcgctacacgaggagaccgcatacggctgtcgcaaagatggacggtatgtgtaccggaagccgcttaatggtttgttcaaaagagaacacgcgaaggacattgtcgatccacagataaagaagattgtcttggagcatcttgatcggcatggcaatgatccgaagaaagcattcatcccggagaatctacccctcttgaaggatggcgcgggcttcaggccgatcaagaaggttagagtcttcgctaagcacagacccacttccgttttcgcggtccgcgatcggcacggacgagacttcaagtttttgaaatacggcagcaaccatcacttggaaatactcgagaatccttccacgggcaaacgagagatgcgcttcgtcacgactatggaggcagccgtacgtgcacgacgcaagaatgtgcccgtctatgaccgctccgcgcccgcaggatggaggtttctaatgagcttgggaattaacgatatggtcgaagtgaatcaggacggtggaaccgactactatcgtgtacagaagttagatggtggaaatcgacggttttacctgcgtcatcacgcctccgcaacgacagaggcgcgagaggaaggactggtcgtcagcacgaagagtttaccgttgatcgtgcgaaagttgtcggtagatccgattgggcagatttcgactgcaaatgattaa

SEQ ID NO: 62 - DNA, 4200 bp, Environmental metagenome
atgaaaaaaattttaggactcgatttaggtacaaattccattggatgggcttacgtcaatgaagcggagaacacaaatgagcaatcgtctataattaaattaggagtgagagttatccctttaaccaccgacgaacaaaccaattttgaaaaaggtaagccaatcacaacaaatgcaagtagaactcttgcacgttcagccagaagaaacttacaacgttacaaactaaggcgagaaaatttaatacaaattctaaaagacaataattggataactgatcatactgttttgactgaaaacggaaataaatcaacatttgaaacctttaaattacgttcagaagcagctgaaagagcattagaattaaatgaacttgcacgagtactgctacatatcaacaaaaaaagaggttacaaaagttcacgtaaagtcaataatacggaagaaggacagcttattgatggaatggatattgctaaaaaactatatcatgaaaatataactcctggagaatttgtattggagctattaaaaagtggcaaaaagaaaattccagatttttaccgatctgatttaaacaatgaatttgaaaaaatatggaacaatcaagctaaatatcacccagacatattcacaaattcattgaaggatgaattaaaaggtaaaggcaaacaagctacttgggctattttaaaagatcctttaaaacttgtaggcgttaaacgagataaaaagcgtgatgaaataaaattagaaaattatcagtggcgagtagatgcattaacacagcaattgaactttgaacagattgctgtagttctacaagaaattaacggccaaataaataactcttcagggtatttaggagctatatcagatagaagtaaagaactttatttcaacaatcaaactgtaggacaatatttatattctcaactgaaagccaatccacatactcgattgaagaaccaggttttttatagacaagattatatggatgagtttgaaaaaatatgggaagtccaatcgaaaggacgtgaacatatttttacagataccttaaaatgcgaaattagagatgtcattattttttatcaacgtaaattaaagtctcagaaaggtcttatttctttttgtgaatttgaacaaaaagaaatttctgtaggagataaaaagaaaatagtaggattaagagttgctccgaaatcttccccactttttcaagaatttaaaatctggcaaaacctccataatgttaagattaaaaacaaaaacactaaagaagtattggtattaaatcaagatgaaaaaaactgtttgttttccgaacttaatgtaaaaggaaaacttaccgctaatcaagtcttaaaattaataaaaggcaatcctaaagattgggaaatcaactatacagaattagatggtaatagaacaaatcaagcattattcgatgcatacctatctatattagaaattgaaggctatgatgtacgagaagaactaaaattaaaattaaacaaagatgatatcacattagccgatattgacaaacctgcagctgaaattatgcatatggttgaaactatttttaaacatttaaaaatagacacgaacatattacattttaatcctctaattgaagggaattcattcgaaaaacaagcatcctaccaattgtggcacttactctattcttacgaagaagataactctccaactgggatggaaacactttatcgtcttttaggcgaaaagttcggatttaataaagaacaagcaaaaattattgccaatgtctcttttcaggatgattatggaagtttaagtagtaaggctattcgtaaaatattcccttatattaaggaaagcgacttctcaacatcttgtgaactagcaggatataatcactctaaaaactctttaacaaaagaggaaattgaaaaacgtgagttaaaaactcgtctagaaatcttgccaaaaaacagtttaagaaatcctgttgtagaaaaaatcttaaaccaaatgataaatgtagtcaataccattattgatactgaaaacgataaacttgaacaggatggtaaaattagaaattttcaatttgatgagattcgcattgaactagctcgtgaattaaagaaaaacgcaaaagaacgagaagatttgtcaaaagccattaatacaggtaaaatagaacatgaccgcataataaaaatccttcaaaatgaagatggaattaaattccctacacgaaatgatatcattcgttacaaactttaccaagagttaaaaaacaatagttataaagatctatacactaatacatatattgagcgaaaagatttatttactaacaaatacgacatagaacatattattcctcaatctcgactttttgatgatagtttttctaacaaaaccatagttcctagacaagtaaacttagagaagggaaatagaactgcgtatgattatatcttagaagtcaaaggggaaaaagcggctgaagaatatactcaacgtattgaacatatgtatacccaaaaagaagacggaatatctaaggctaaatataaaaagctattaatgaaagaatctgaaattggaagtggttttatagaacgtgacttaagagattcacaatatattgcgaaaaaagccaaagaaatactcttccaaattaccaaatctgtggtatctacttctggttctataaccgatcgtttacgtcaagattggggattaatagacgtaatgaaggaattaaatcttcctaaatacgaaaaagcaggtttagttgaaattcaacatgacaaaaacgggcaacccaaaaaggtaataaaaaactggactaaacgcaatgaccaccgccaccacgcaatggatgcgttaacagtagcatttactaaacatagtcatattcaatacttaaacaacttaaacgcgcggaaaaatgaagattcagaaaagaaggcgaacatatatgctattgaagaaaaagaaacagtaaaaattaatgatggaaaaggaaatagtaaacggattttcaaagagccaatattaaactttagagatgaagctaaaaaacatttagaatgtgtattggtctctcataaggctaaaaacaaagtagtcacaagaaatattaataaaattaagggctctgataaaaaacaaatagctttaacccctcgtggtcaaatgcataaagaaaccgtttatggcagaataaagcaatacaattctaaaatagaaaaagttagtgcaaaatttgatgaagatactattgctatggtttcaaatcctcaatatagatctttattattacaaagacttaaagaaaatgggaatgaccctaagaaagcatttacaggcaaaaatgccttagataaagctcctattctacttaaaaatggtactccgttacctgataaagtaaaactgatttggttagaagataacttcaccatccgcaaggaaatcaatccagacttaaaaattgataaagttatagatgaaggcattaaacgaattttacaaaagagattagatgaatttaaaggcgatccgaaaaaggcttttgccgatttagaaaacaacccaatttggcttaataaggaaaaaggaattgcaataaaacgtgtaacgatttcgggtgtaaaaaatgctgaagctttacatactgctaaagatcatctaggaaataaacgtttagacaaaaatggtcaagaaattccagtggattttgtaagtacaggaaataatcaccatgtagcaatatatgaagacgaaaaaggtaacctacatgaaaaagttgtctcattctatgaagcagttgcaagggtaaaccaaggacttcctattattgataaatcttataacaaagaccttggttggaagtttttattcactatgaaacaaaatgaaatgtttgttttcccatcaaatgattttaatccaaaagaaattgatttattagacaaaaagaaccaagcgctaataagtaaatatctatttagggtacaaaaattttcagaaaaggattacaattttaggcaccatttagaaacacaaattattgatactcctcaattaaacaacataatagcaattagaaaaagaaatccaaattctttaaaaggagttattaaaattagaataaatcatgtaggagatattatacaaattggtgaatattaa

SEQ ID NO: 63 - DNA, 3375 bp, Environmental metagenome
atggattccaaaaaaattctcggactggatctgggaacaaatagtattggctggtcactggttgaaatcaatcgggaagaaaatcaaggtcgcattttaggaatgggtgtgcgtatattccctgagggtgttgaaaacttaaatcagggagaaaaggagatttcaaaaaatgccgcacgcaatgttaacagaagtgcacgccggcaaattcagcgaagaaaaaggagaaaaactgatctgctgaaaattttaattcagtacgacatggctcctcaaggggattttaaggatcaggcatattggctatctcctgaatttttgaaatgggtagcactaaacccttatgaactgagacatcgcgccattactgaaaaaattgcactcaaagaacttggtcgcgtattctaccacctggcacagcaccgtggcttccaaagcaatgcccgcaatgtatcagataatgacgattcaaccatttacaaaggcggtaatggcatgaccggcattgatacaacagcatcattgattgaaaatgaaacacttgggtcggcactatatcaaaagctttttccagctcctggacaacctttcaaatatttcccggaaagaatccgccgtcgatatacaacccggaaaatgtatattgatgagtttgagaaaatctgggaagagcagagtcgctttcatcctgagttgacccaacaacttaacgaagaaatagggggcaggcgtcgcgaaggatataaacgagacggtgtattattctttcaacggcctttgcgatctcaaaaaagcaagattggcaaatgtacctttcatcctaataaaagtcgtagggcaatcagcgcaccagacttcgaagaattccgcatctggcagtttattaactccattagatgtaatggcgaatctctagttgatgcggacaggcaacttgtatataacctgctggtaagtcaggacagggtaaaatttgacaaactgagaaaacatcttggcaaggcgagtgcggcatattcgtttaatttcgatgatgaaacttcctgtccaaatgctcctacattacgatttctgtcatcaagagggatttttagtcaatcatggtttggattcaaaaagtcaaagcaggaagaaatatggcacgatctctatttctatgatgacaaagaattacttcgtaaacgtgcccaggaaaaatggggcttaagtgaggatgccgcgacaaagtttggagattattccttgaagcaaggttttgcttcacttagccgacgagcgattcaaaatattttgccctttctggcattaggtcatgattacgatgtagcagtaacactgggtggaatcaaaaacgcccttggagatcaaaacattgttgacatatacgacaccgatttccgaattgctgtagaggaaattgttcgtaccaatccccgaggtggttatataaatcatcttaaggcatggcttaaagacaactatggttttgaagataagcgtttggaaaaactctatcaccattctgccgatgtaaatgaacgaaaattactgaaccgccttccttacggcatggaagctgaccgacaaatccaacaattgcgcaaccccatcgtcatccaggccttatttgaattgagaaaagttatcaatgaattacttgagcgattcggcccattcgacgaaatcaagattgagttgggccgggacttgaaaaacccgaagaatcgcagactggaaattcagcgacaaaacaagcgacagcagcaatatcatgaaaaggtaattgataggctaagagagctcggcatagatgaaacctatgacaacgtcctcaagtataaactctgggaagaatgcaatgccacctgtccgtatacaggaagaccgatcgctgtcaatcaattattttccaatcagatacagattgaacatatcattccttacagtcggtcgctcgatgatagcttcatgaataaaaccctgtgcttctcagatgaaaatgctagaaagggtgaccgtacaccatatgaatactatcatggagttttaggatctgaaaagtgggtagatgtcaaacaacgagcactatcgctcttcaaaaacagcagggatttcccaaatcggtataaaaaattcgagcgatttgttctgacaagcacacaagaccttgaaggatttatcagccgccagctcaatgacacccgctacatcagccgggaagcagcagaatatttgaggcaaatatgtcctaaagtctgggtggcctcagggcagttaacagcccgactccggcatttatggggactaaactccattatagatgataaaagcaatcaaaaagatcgctccgatcatcgacatcatgccattgatgctttagttgtagctgttcatacacaccgcgatctccagttgatgtcaaggctcaatcgccatggcatcagtccggacagtttggcagatgcgtttccattcccatggcctggctttcgttctgatgcagaaacctatgtgagcaatatcctggtatctcataaaaccaaccatagagtcgtttctacacgactgaccataacaagaagcaaaggcaaggttttcagaaataaatcttctgctgcaagaggagcacttcacaaagaaaccgtttatggcaagagaaaactgttagatggtagttataaataccatgttagaaaatcactcgaggatatcaaagaaaaagcacaggtagataagatagttgatcaaaaaattaaagacctcgtcagaaaccgcttgagggaacttggggtggatataacgatgaaaaaatataaggtcccaccaggtgcattcttttcaaaagatgaaaatgggcaaatattacccctgatttggttaccaaacaatcgaggtggaaaggttcctgtctattctgtgaggatcaatgaagaattaggcaatgctgctcaattaaaatcttctcaaaatcaatatgtaaatccaagaaacaatcaccacatattgatttacaaatcgaaaaatggcatcctaaaggaggacatcatttcattctgggttgctgctgagcgcatccgacaaaagtctccagtataccagatacctgctgattgcgaggaaattatcgcaattcttcgaaaaaacgatatgtttttaattggatgggatatttctatcccagaaaattctactgaaatcctatcaaggcatttatatagggttgataacctaagctctttggattatgtttttaaacaccatttaactgacaatgatgaagaaaaggtacgaatccagagttttaaaaaatggcaagagttaaatcctattaaggtcagaatttcatcaactggcaaggtgatcggtttggtatag

SEQ ID NO: 64 - DNA, 4077 bp, Acidaminococcus_intestini_RyC-MR95; identical to SEQ ID NO: 44

SEQ ID NO: 65 - DNA, 4155 bp, Coriobacterium_glomerans_PW2
atgaaattgcgggggattgaagacgactacagcatcggcttagacatgggtacgtcatcggttggatgggcggtgacggacgaacgagggacactcgcgcacttcaagcgaaagcccacatggggaagcagactcttccgagaggctcagaccgcagctgtcgcacgcatgccgcgcggtcagcgaagacgctatgtcaggcggcgatggcgtctcgaccttcttcagaagctcttcgaacagcagatggagcaggccgatccagactttttcattcgactcagacagtccaggttgctgcgggacgatcgcgcggaggagcacgcggactatcggtggccgctgttcaatgattgtaagtttaccgaacgcgactattatcaacgctttccgacgatctaccatgtacgcagctggcttatggaaactgacgagcaagcggatattcgtctgatctatctcgcattgcacaatatcgtcaagcaccgtggcaattttctgcgagagggacagagtctgagcgcaaaaagcgcccggcccgacgaggcgctcaatcacctccgagagacgctccgggtctggagctccgagcgcggattcgaatgctccattgctgataacggcagcattcttgccatgctgacgcacccggacctctcgccctccgacaggcgaaagaagatcgctcccctgttcgatgtgaaatccgacgacgctgcggccgataagaagctcggaattgcgttggccggtgctgtgatcggactcaaaacggagttcaagaacatcttcggagatttcccctgcgaagactcgagcatctatctttcaaatgacgaagcagtggatgcggtccgatcggcttgtccggatgactgcgccgaactgttcgatcgactgtgcgaggtctactcagcatacgtgcttcaaggtctgctgtcgtatgcgcccggacagaccatctcagccaatatggtagagaagtatcgccgttacggtgaagatctcgcgttgctcaagaaactggtcaagatctatgctcccgatcagtaccggatgttcttctccggtgccacctatccagggacgggtatctatgatgccgcccaagcacgcggttacaccaaatacaatctcgggcccaaaaaatcagaatacaagccaagcgaatccatgcagtatgacgacttcagaaaagcggttgagaagcttttcgccaaaaccgacgctcgtgctgacgaacgctatcgcatgatgatggatcgatttgacaagcagcaattcctccgtaggctcaaaacaagcgacaacggaagcatctatcatcaactccaccttgaagagctcaaggccatcgtcgaaaatcaagggcgcttctatccgtttctcaagcgggacgcagacaaactcgtctcgttggtctcatttcgcatcccctattatgttggaccgctttcaacaagaaacgcccggaccgatcagcatggcgagaatcgattcgcatggtccgaacgcaagccgggtatgcaggacgagccgatctttccatggaactgggagtccattatcgatcggagcaaaagcgcggagaagttcattctgcgtatgacggggatgtgcacgtaccttcagcaggagccggttttgcccaagtcgtctctcctatacgaggagttttgcgtcttgaatgagctgaacggcgcccattggtccatcgacggtgatgacgagcatcgcttcgatgccgccgatcgagaaggcatcatcgaggagctcttccggcgcaagcgcacggtgagctacggcgatgtcgccggctggatggagcgcgagcgaaatcagatcggagctcacgtgtgtggcgggcagggagaaaaaggattcgaatcgaaactcggatcatatatattcttctgcaaggacgttttcaaagtcgaacggctggagcaatcagactatcccatgatcgaacggatcattctgtggaatacgctgttcgaggatcgcaagattttaagccagcgcctcaaggaggagtacggcagcaggctatcggctgagcagataaaaacaatctgcaaaaaacgtttcaccggttggggccggttgtcagagaagtttctgacgggcatcaccgtgcaggttgatgaagacagcgtatcgatcatggacgttttgcgcgaggggtgccccgtctcgggcaaacgcgggagagccatggtgatgatggaaatcctgcgcgatgaggagctgggctttcagaagaaggtggatgatttcaacagggcgtttttcgctgagaatgcccaagcgctcggagtaaatgagctgcccggttcccccgccgtccgcagaagcctcaatcaatcgatacgcatcgtcgatgagatcgcatcgattgccggaaaggcaccggcgaacatcttcatcgaggtcacaagggatgaggatcccaaaaagaagggcaggcgcaccaaaaggcgatacaacgacctgaaagatgcgcttgaggcattcaagaaagaggatcccgagctatggcgagagctttgcgaaacggctcccaatgatatggacgagcgtctgtcgctctatttcatgcagcgaggcaagtgcctctattccggacgcgcgatcgatattcatcagctcagcaatgccggaatatacgaggtcgatcacatcattccgcgcacctatgtcaaagacgacagtttggagaacaaagcactggtgtatcgagaggagaaccagcgcaagaccgacatgctgctcatcgatcccgagatccgacgacggatgagcggatattggcgcatgcttcatgaggccaaactcatcggagacaagaaattcagaaacctgctgcgctcgcgcatcgacgacaaggcactgaagggtttcatagctcgccagctcgttgaaacaggccagatggtcaaacttgttcggtccctcttggaggcgagatatccggagacgaacatcatctccgtgaaggcgagcatctctcatgacctacgcacggcggcagagctcgtaaagtgccgtgaggcaaatgattttcatcatgcgcatgacgccttcttggcatgtcgtgtaggactgttcattcagaagcgccatccatgcgtttacgagaaccccatcggtctgtcccaagttgtcagaaactatgtcagacagcaagcagatatcttcaagaggtgccgcaccatcccgggttcaagcggcttcatcgtcaacagcttcatgacctctggatttgacaaagaaaccggcgaaatcttcaaggatgattgggatgcggaagcagaagtcgagggcatccgtcgctcgttgaattttcgacaatgtttcatcagtcgcatgccattcgaagaccatggggtcttttgggacgcgacgatctattctccgcgcgctaagaagaccgcggcgctgcctttgaagcaagggctcaatccaagcagatacggctctttctcgcgtgaacagtttgcttacttttttatatataaggcacggaatccaagaaaggagcaaacgctgttcgaattcgcccaagtccccgttcggttgtcagcgcagatcaggcaagatgagaatgcgctcgagcgctacgcgcgcgaacttgccaaggatcaaggcctcgagttcatccgaatcgaacgatcgaagatcctgaaaaatcaacttatcgaaatcgatggcgaccggctctgcatcacagggaaagaagaagtccgcaatgcttgtgaacttgccttcgcacaagatgagatgcgcgtgatcaggatgctggtaagcgagaaacccgtttcacgagaatgtgtcatatcgttgttcaataggatcttgttacatggtgatcaggccagtcgaagattatccaaacagctgaagctcgcgttgctttctgaagcgttttccgaagcctcggacaacgtacagcgtaacgtggtgctaggacttatcgctattttcaacgggtcaaccaatatggtaaaccttagcgatatcggaggaagcaaattcgcgggaaacgtgcgaatcaagtataaaaaagagctcgcaagcccaaaggtcaatgtccatctcatcgatcaatcggtaacaggaatgttcgaaaggaggacgaaaattggcctttag

SEQ ID NO: 66 - DNA, 4143 bp, Eggerthella_sp._YY7918
atgaatttaagacatgtcggtaattacaacataggtcttgatatgggaacggcttctgttgggtgggctgccatagacgagcagggagagttgcttcattttaaaggtaaacccacttggggtagtcgcctgtttgattcggcaaatacggccgcaacagcacgtatgccgcgagggcaaagacgtcgctacattcgtcgcaggtggcgacttgatttactccaaaagttcttttcggaagaaatggctgaaaaagaccccgagtttttcattcgcttgcgccaatcgagcttatggccagaagatcgggaaggtgggcataccgcctaccattggccgctgtttaatgattccgattttaatgaaaaggaatactacgaaaagtttcctactatatttcatttgcgtcagtggttaatggaaaccgatgaaaaggccgacattcgtcttatctacttggcatttcacaatatcgtaaaacataggggtaatttcttgcaggaaaacaacgactcgttaagcgcacaaaatgcgaacatgagagaatcgttagagtcattctgcatagcattagaagaatggtgtgacgaaaaagaactaacatgttcttgtgatccacagaaacttgagcatcttttcaaggaagtgaaataccgttcggatattcgtgatggttttgctgctctgcttggtctagcttgttcaggtgaaaacgaagtagacgtaaaagctatggcaaaagaaatggggaaggcgatcgtcggctacaaagccgacttctccaagatttttaccgagtgcgacaaagaaggttcgtcttttcgactttcagatgatgagggacccgaggcatttttggacatatgccccgatgacggaatagccctttttgaagcgatccaaatggtgtactcctcgtttattctgacgggaatgttgaccgaaaagggcctgtcgttaagtaagatttctgcctacaaccaatacggccaagacttagaatcgcttaaagcactggtaaaagaatacgtccccaatgaatacagtagcttttttcgtggaccgacctattctggttcgacggaatatgacccctcaaaagctcaaggatatacgcgttacaaccttggaccaagcaaaaagggttctggggcaaagcctatggcttacgaagatttcaagaagagcgtcgaacagctttttgctaacacgaatgctattaacgacgagcgttacaaagaaatgatgggacgctttgcggaagagaagtttctcaggcgattgcgaactagtgataacggtcgtattcctttccaacttaatcttgaagaaatgaccgcaatcattataaatcaaggaaagtattatccatttttgcttgaacagcaagaaaagcttgagtcgctcgttagatttcgaattccctattatgtgggaccccttacgaggataaatgcgcgtcttgatagcaagggcaatgcgtgttttgcttggtcaaagagaaaagatggcatggatagtgcttcaattaagccttggaactgggatgaagttatagataagcacgcgagtgcacaagcttttattgaacgtatgacgggaacttgtacctacttgcgcggagaacctgttttgcctcgctgctcgcttctctatgaggagtattgcgtgctgaacgagctgaacggtgcccgttggactcaagatggcgataagtttattcggtttgactacaaggatcgctcagacattatagaagagctcttcaaaaaacgtcgcgggcgtattcagtatgcagcggtggcagattggatgaagcaggagcgtagtcatgccaatgtgcatgtttcgggcgggcaaggcgaaaacgcctttgagtctcgcttgagctcctatcattttttctgcaatgacgtttttggagttgacgagctgcctggctcgtatgttgacatggttgaggaaattatcttatggagtacgctttttgaagaccgctctattctgcgtgaagaaatacagcgcaagtatggcgatgtattaaatgaagagcaaatcaagactatctgcaaaaagcgttttagcggctggggaaggctctcaagaaagttactctgcagtctaaaagcgcaaaccgacaatggaccaaaatccattatggatattcttcaagaaggtgatcaaaacaacggtcgcgtcggccgcgcgatggtgtttcaagaaattcttcacgatgaacagttgggttttgagcagaaaatcgaggaagaaaatactcagagcatgctagaaggcgaaaacttgctcattgaagatttacctggttcccctgctatacggcgttcgattaaccaagcggtgcgtattgtcgatgaaatagtgggcattgcaggacatgcgccggacaacatctttatagaggtaacccgcgaagacgatacaaagaaaaagggtaaacgaacgactacgcgctacagtaatattcaaaaggcgctagaagcacttaaggaagagggtgccgaggctctgcgcgagctaaaaacgtataaacataacgaactagacaagcgcctttcgctttactttatgcaaaacggcaagtcgctttactcgggtatccctctggatatacggcggttgagtgagtaccaaatcgatcatattatcccgcagtcttatataaaggacgatagttatgaaaacatggctttggtattgccgggcgagaaccaaagcaaggcggacaaccttttaatttcgcaggatatccgcataaagatgaaggcaacttggactgctttgcataaagcaggacttatgggcgataagaagtacaacaacttgatgaattcgtctatctcagatgcgaagatgaagggttttatcaatagacaattggtagaaacaagccaaagtgtaaagcttacgcaaatgatgttgtctcagaagtatcccggtgcaaaagtccgtcctattaaggcgagcatttcatcgcagctgcgtgatgcatgcgaccttgtgaaatgcagggaggcaaatgattaccaccatgctcacgatgcttatcttgcctgtcaagttggacgctttgtgcttaagcgacacagcagtatgtttgacaatcctatcggaatgacaaaggttattcgcgactttgtaaaaagacaagggcaagaattcaagagaaatggaaagctgccagcttatgcgagtcgttcagggtttattgttcagagtttcatgcgttcgggatttgatgcagaaacgggagaattgttgcgcgatgattggaacgctccatttgaaatagctcggattaagcgttgtttgaattatcgagattgctatatttctcgtatgcccatggaggattcgggtgcattttgggatgcgacaatctattcgccaaaggcaggaaagaagggggctctcccggtaaagcagggtttaccagtagaaaaatatggcagttattcgcgcgagcaatttgcctacttctttgtatacaaggcctacaatcctaagaaaaaggcctatcggcttgaatttgaggctgtaccggttagggttgcttctgcggtagagacgcgtgaaaacgcgctcgaggagtacgcgaaaagtgtcgctaaacaagcagggcttgagtttgtggaagtggctcggcctaaggtctacaaatatcaactcatagaacttggagaggatcgtttgtatattacgggtaaaagggaagttcgcaatgcctcgcaacttgccttttcgctcgatgagattgaccttttgaagcgattagctgaaggggaagaaacttcctccgaagaaagagagcgattgtttgatgttctgattgagaaatatgcacgatatgcaccgaggttagctcgtcagttgagcgtagatagtatgagtgcaacgttcgaaacgcttaatgctgaggagcaattgggtattcttctatctttagtagaaattgcaaatggaaaaagaaacatgattgatctttcgagtgcagggggtagcaagaatgcgggctgtatgaaccctactttttccagtgaattgtcttctcccggctccaactttacttttattgaccaatcggtaaccgggatgttcgaaaggcggcagcgccttgagctttag

SEQ ID NO: 67 - DNA, 4047 bp, Finegoldia_magna_ATCC_29328
atgaaaagcgaaaaaaaatattatatcggattggatgtaggtactaatagtgtaggatgggctgtgactgacgaattctataatattcttagagccaaaggaaaagatttgtggggagtaagattatttgaaaaagcagacactgcagcaaacacaagaatatttagaagtggtagaagaagaaacgacagaaaaggtatgcgtcttcaaattttgagagaaatttttgaagatgaaatcaaaaaggttgacaaagacttctatgacagacttgatgaaagcaaattctgggctgaagacaagaaagtatctgggaaatattcgttatttaatgataaaaatttcagcgacaagcaatattttgaaaagtttcctactatttttcatcttagaaaatatttaatggaagaacatggaaaagtagacattagatactattttctagctatcaatcaaatgatgaaaagaaggggacattttctaatagatggtcagatttctcacgttacagatgataaaccattaaaagaacaacttattctattaataaatgatttattaaaaatcgaattagaagaagagcttatggattcgatatttgaaattttggcggatgtgaacgagaaaagaacagacaagaaaaacaatctaaaagagcttataaaaggacaagattttaataaacaagaaggtaacatcctaaactcgatttttgaatcaatagttactggtaaagcaaaaataaaaaatataatttcagatgaagacattcttgaaaaaataaaggaagataacaaggaagatttcgttcttacaggagatagctacgaggaaaatctccaatattttgaggaagttttacaagaaaacataacattgtttaacacacttaaatcaacatatgattttttaatccttcaatctattttaaaaggtaagagcacactttctgatgcacaagtcgaacgatacgatgaacataaaaaagacctcgaaatacttaaaaaagtaataaaaaaatacgatgaagatggaaaattgttcaagcaagtattcaaggaagataatggaaatggatatgtttcatatattggatattatttgaacaaaaacaaaaagattaccgcaaagaagaaaatatcaaatattgaatttacaaaatacgttaaaggaattcttgaaaaacaatgcgactgtgaagatgaagatgttaagtatttattggggaaaatagaacaagaaaactttctattaaaacaaatatcatccataaattcggttattccacatcaaattcacctttttgaattagataaaatattggaaaacttagccaaaaactaccctagctttaataataagaaggaagaatttacaaaaatagaaaagatcagaaaaacatttacatttaggattccatattatgttggaccattaaatgattatcacaaaaacaatggcggaaatgcttggatattcagaaataaaggcgaaaaaataagaccatggaattttgaaaaaatagttgatcttcataaaagtgaagaagaatttatcaaaagaatgctaaatcaatgcacttatcttccagaagagacagttcttcctaaatcttctattctttattcagaatatatggtgctaaatgaattgaataatttgaggattaatggaaagccactagataccgatgttaagttgaaattaattgaagaattattcaagaaaaagacaaaagtcactctcaaatcgatcagagattatatggtaaggaataactttgcagataaagaagactttgataattcagagaaaaacttggaaatagcatccaatatgaaatcatatattgattttaacaatatattagaagacaagtttgacgtagaaatggtggaagatctcattgagaaaattacaattcatacgggaaataagaaacttttgaaaaaatacatcgaggaaacttatcccgatttatcaagttctcaaattcaaaaaattatcaaccttaaatacaaagattggggaagattatcaagaaaattattagacggaataaaaggaacaaaaaaagaaacagaaaagactgatactgtaattaatttcttgagaaattcaagtgacaatttgatgcaaataattggaagccaaaattacagctttaatgaatatattgataagttaaggaaaaaatatattcctcaagaaataagttatgaagtggttgaaaatctttacgtatctccatctgtaaaaaagatgatatggcaagttataagagttacagaagaaatcacaaaggttatgggatatgacccggataaaatcttcatagaaatggcaaaatctgaagaggaaaaaaagacgacaatttctagaaaaaataaattactagacctatataaggcgataaaaaaagatgaaagagatagtcaatatgaaaagctattaacagggttgaataaattagacgatagcgatcttagaagcagaaaactttatctttactacactcaaatgggtagagatatgtacactggcgaaaagattgacctggataaattattcgattctacacactacgataaagaccacataatacctcaaagtatgaaaaaagatgattcgataataaacaacttggtattagtaaataaaaatgcaaaccaaaccacaaaaggcaacatataccctgtaccatccagtataagaaacaatccaaagatttacaattactggaagtatttgatggaaaaagagttcatcagcaaagaaaaatacaatagattaataagaaatacaccactaacaaatgaagaacttggcggattcatcaacagacaacttgtagaaacaagacaatcaacaaaagcaatcaaagaattatttgaaaagttctaccaaaaatcaaaaataatacctgtaaaagcaagtcttgcaagtgatttgagaaaagacatgaatacccttaaatccagagaagtaaatgaccttcaccatgctcacgatgcgtttttgaatattgtagcaggagatgtgtggaatcgagagttcacatcaaatccaataaattatgtcaaagaaaacagagaaggtgacaaggtaaaatattcgttaagcaaagattttacaagacctcgtaaatccaaaggaaaagttatctggacacctgaaaaaggtagaaaattgattgtagatacattgaataaaccatcagttctaatcagcaatgaaagtcatgtaaaaaaaggagagttattcaacgctaccattgcagggaaaaaggattacaagaaaggtaaaatatatcttccactaaaaaaagacgatagattacaagatgtatcgaaatatggaggatataaggctataaatggagcgttctttttcttggtagagcatactaaaagcaagaaaagaataagaagcatagaattatttccgttacatttgcttagtaaattttatgaagataaaaatacagtattagattatgcgataaatgtattgcaattacaagatccaaagataataatagacaaaattaattatcgtacagaaataattatagataattttagttatttaatatccactaaatcgaatgatggtagtataactgttaaaccaaatgagcaaatgtattggagagttgatgaaatttcgaatttgaaaaaaatagaaaataaatacaaaaaagatgccatattaacagaagaggatagaaaaattatggagagttatattgataaaatctatcaacaattcaaggcaggaaaatacaagaatagacgcactactgatacaataatagaaaaatatgaaataatcgatctagacactctagataataaacaattataccaattactggtagcttttatttcactttcatataaaacatcaaataatgcagtggactttactgtaattggactaggtactgaatgtggaaagccaagaattacgaatttacctgacaacacatatctagtatataaatcaataacaggaatatatgaaaagaggataagaataaaataa

SEQ ID NO: 68 - DNA, 4086 bp, Lactobacillus_rhamnosus_LOCK900
atgacaaaattgaaccagccatatgggattgggcttgacattggttccaattcgattggctttgcggttgtggatgcgaatagtcatctcttgcggctgaaaggagaaacagccatcggtgcacggctatttagagaggggcaatcagctgctgaacggcgggaaagtcggacgactcggcggcgtttgagtcgaactcggtggcgcttaagctttttacgcgatttctttgccccgcacattacaaaaattgacccggatttcttcttgcggcaaaagtattccgaaatttcgcccaaagacaaggacaggtttaagtatgaaaagcgtctgtttaatgatcgaacggatgctgaattttacgaggactatccgagtatgtatcacttgcgtctgcatttgatgacgcatacgcataaagccgatccgcgtgagattttcttggcaatccatcatattttgaaaagtcgcgggcattttttgacgcccggtgctgctaaagactttaatacggataaagtcgatttagaagatatttttcctgccttgacagaggcatatgcgcaagtttatcccgatcttgagttaacttttgatttggcaaaggctgatgacttcaaggcaaaattgctagatgaacaagcgacgccgagcgatacccagaaggccttggtgaacttgttattaagcagtgatggtgagaaagaaatcgtcaagaaacgcaaacaagtgctgacagagtttgccaaagcgatcacagggctaaaaaccaagttcaatcttgctttaggtacagaagtagatgaagctgatgcgtcaaattggcaattctcgatggggcagctggacgacaagtggagtaacatcgaaacttccatgaccgatcaaggaacggaaatatttgaacaaattcaagaactttatcgagcacgattgctaaatggcattgtgccagcggggatgagcttatcccaggcaaaagttgctgactatgggcaacataaagaagatcttgagctgtttaaaacctacctcaagaaactaaatgatcacgaattagctaaaacaattcgaggtctttatgatcgatatattaatggcgatgatgctaagccttttttgagggaagactttgttaaagccttaaccaaagaagtaaccgcacacccaaatgaagtgtcggagcagctgttgaatcgaatgggacaggcaaacttcatgctcaaacaacgaactaaggccaatggtgcgattcctgtccaactgcaacaacgtgaactagaccagattattgctaatcaatccaaatactacgactggcttgccaaaccgaatccggtagagaagcatcgcgctagcaaaccttatcagctagatgaactgttaactttccgaatcccttactatgtaggaccactgatcacgccaaaagaacaggccgagtcaagagaaaatgtctttgcatggatgatccgtaaagatccttcaggcaatattaccccttacaattttgatgaaaaagtcgactgtccagcttcggcaaacatgtttatccaacgcatgaaaaacaccgatacttatttgattggcgaagatgtcttacctaaacgaagcctgttatatcaaaagtatgaagttttgaatgagttaaacaacgtcagcattgatggtaggaggcttggcgcagatcaaaaacaacgcttgatccgcgaagtgttcgagcgacatagcagcgtgaccattaaacaagtcgccgaaaatctagttgctcatggagattttgccaaacgcccagagattcgtgggctggcagatgagaaacgcttcttaagttcgctttcaacctatcatcaattgaaaaagatcttacatgaggcaattgatgatccgaccaaagagcatgatatcgaaaatattattacgtggtcgacagtttttgaagatgccgcaattttcaagaccgagctggctaaaattagttggttggattcagatacaatcaaggcattaagcaacatccgttatcgtggctggggtcagttctcgcgcaagcttttagatgggttgaaactaggcaatggccacaccgtaattcaggaattaatgctttcgaatcataacttaatgcaaattttgaccgatgaaacgttgaaaacaacgatggcggaattaaatcaagacaaactgaaggcagacgacattgaagatgtcattaatgatgcatatacttcgccaagcaataaaaaagctttgcgtcaagtgttacgggttgttgaagacatcaagcatgcagcaaacggtcaagatccaagttggctttatattgaaacggcagacggaccaggcactgccggtaaacgcacccagtcacggcaaaagcaaattcaaacagtttacgctaatgctgcccaagagctgattgatagtgctgttcgtggtgaattggaggataaaattgctgacaaggccagctttaccgatcggctagttctttacttcatgcaaggcgggcgggatatttataccggcgcaccgctgaatatcgatcaactcagccattatgacatcgatcacatactgccacaatcgttgatcaaggatgactctttagataaccgtgtgctcgttaacgccaccattaaccgcgaaaagaacaatgtatttgcttcaactttgtttgcaagcaagatggcagcaacttggcgtaagtggcacgaagccggtctaatcagtgggcgtaaactcagaaacttgatgctgcgtcctgatgagatcgataagtttgcgcacggatttgtcgcgcgtcaattggttgagacacgtcagatcattaaattaaccgaacagattgccgcggcgcaatatcccaacaccaagatcatcgcggtcaaagctggcttatcacatcaactgcgcgaagaactagactttccaaagaatcgtgatgtgaaccactaccaccacgcatttgatgccttcttagcagcgcggatcggcacgtatctgcttaagcggtatccgaaattggcgccatttttcacgtatggcgaatttgcaaaggtcgatgttaagaagttccgcgaattcaacttcattggtgcactaacacatgctaagaagaatattgtcgctaaagataccggcgagattgtttgggataaagaacgtgatatccaagagttggatcggatatataacttcaagaggatgttgataacgcacgaggtttactttgaaacagctgatttgttcaagcagacaatttatgctgccaaggattcgaaagaacgtggcggaagtaagcagctgattcctaagaagcagggttatccgactcaggtttatgggggttatacacgggaaaatacggcttatttggcggtggttaaaactgttgaaaagaaagcagatgtctatagagttgtcagaattgcaacttctcaagtagcggcattgaaagaagctagagcgcaatcgactgtcaaagaacgagaattattaaagaagtttttgacaacaaaattcacaaaaatcgggaagaacggtaaaaaagcaataacgccatttgatatcgttattccacgagtaccacgcgaacaactctttcataataaacgttatggctttttcatggttaattccgatacgctgatgcataactatcaggaactgtggatgtcacgctccgatcagcaaattttgtcaaaacttgtaaagtctgcgaaaactgtggaaaatggccaagtcggcaggctgtttgaaaatatagtggaacagattaataagtattttcctctgtatgatattaatcaattccgaaaaaagcttgatcaaagcaaagatatattttcaaaattaccattggaaggaaatggtacaacctcagggaagagagaaaccattcagaatattctaactggagcaggaactggtgcaaagaatggtgacttgaagaacttgggcataaaaacaccttttggttttttgcaagttccaagtggtattgtgctggatgacgacaccacattgatttatcaatctccaacaggaatgcttaacagaattgttcgattaagcgaactataa

SEQ ID NO: 69 - DNA, 4035 bp, Mycoplasma_gallisepticum_CA06
atgaaaaaaccttactctattggacttgatattggaaccaattctgttggttgggctgttgtgacagatgactacaaagttcctgctaagaagatgaaggttctgggaaatacagataaaagtcatatcaagaaaaatttgcttggcgctttattatttgatagcgggaatactgcagaagacagacggttaaagagaactgctcgccgtcgttacacacgtcgcagaaatcgtattttatatttgcaagagattttttcagaagaaatgggcaaggtagatgatagtttctttcatcgtttagatgagtcatttttgacagatgatgataaaaattttgattcacacccaatcttcggcaataaagcagaagaagatgcctatcatcagaaatttcctacaatttaccatttaagaaaacatcttgcagattcaactgaaaaagctgatttacgcttggtttatctagctttggcacatatgattaaattccgtggacatttcttaattgagggtgaattgaacgccgaaaatacagatgttcaaaaattattcgctgatttcgtaggagtgtatgatagaacatttgacgatagtcatttatcagaaattacggttgatgcttcgagtattttgacagaaaaaattagcaaatcacgccgtttagaaaaacttataaataactatccaaaggaaaagaagaatactttatttggaaatctcattgctttgtctttaggattacagcctaattttaaaacgaattttaaattatctgaagatgctaagttgcaattttctaaagatacttatgaagaagagttagaagtactattagctcaaattggagataattacgcagagctctttttatcagcaaagaaactgtatgatagtatccttttatcagggattttaacagttactgatgttagtaccaaagcgcctttatctgcttcgatgattcagcgatataatgaacatcagatggatttagctcagcttaaacaattcattcgtcagaaattatcagataaatataacgaagttttttctgatgtttcaaaagacggctatgcgggttatattgatgggaaaacaaatcaagaagctttttataaataccttaaaggtctattaaataagattgagggaagtggctatttccttgataaaattgagcgtgaagattttctaagaaagcaacgtacctttgacaatggctctattccacatcagattcatcttcaagaaatgcgtgctatcattcgtagacaggctgaattttatccgtttttagcagacaatcaagataggattgagaaaatattgactttccgtattccctactatgttggtccattagcgcgcggaaaaagtgattttgcttggttaagtcggaaatcggctgataaaattacaccatggaattttgatgaaatcgttgataaagaatcctctgtagaagcttttatcaatcgtatgacaaattatgatttgtacttaccaaatcaaaaagttcttcctaaacatagtttattatacgaaaaatttactgtttacaatgaattaacaaaggttaaatataaaacagagcaaggaaaaacagcattttttgatgccaatatgaagcaagaaatctttgatggcgtatttaaggtttatcgaaaagtaactaaagataaattaatggatttccttgaaaaagaatttgatgaatttcgtattgttgatttaacaggtctggataaagaaaataaagcatttaacgcttcttatggaacttatcatgatttgcgtaaaattttagataaagattttctcgataattcaaagaatgaaaagattttagaagatattgtgttgaccttaacgttatttgaagatagagaaatgattagaaaacgtctaaaaaattacagtgatttattgaccaaagaacaactgaaaaagctggaaagacgtcattatactggttggggaagattatcagctgagttaattcatggtattcgcaacaaagaaagcagaaaaacaattcttgattatctcattgatgatggcaatagcaatcgtaactttatgcaactgattaacgatgatgctctttctttcaaagaagagattgctaaggcacaagttattggagaaacagacaatctaaatcaagttgttagtgatattgctggcagccctgctattaaaaaaggaattttacaaagcttgaagattgttgatgagcttgtcaaaattatgggacatcaacctgaaaatatcgtcgtggagatggcgcgtgaaaaccagtttaccaatcagggacggcgaaattcacagcaacgtttgaaaggtttgacagattctattaaagaatttggaagtcaaattcttaaagaacatccggttgagaattcacagttacaaaatgatagattgtttctatattatttacaaaacggcagagatatgtatactggagaagaattggatattgattatctaagccagtatgatatagaccatattatcccgcaagcttttataaaggataattctattgataatagagtattgactagctcaaaggaaaatcgtggaaaatcggatgatgtaccaagtaaagatgttgttcgtaaaatgaaatcctattggagtaagctactttcggcaaagcttattacacaacgtaaatttgataatttgacaaaaggtgaacgaggtggattgaccgacgatgataaagctggattcatcaagcgtcaattagtagaaacacgacaaattaccaaacatgtagcacgtattctggacgaacgatttaatacagaaacagatgaaaacaacaagaaaattcgtcaagtaaaaattgtgaccttgaaatcaaatcttgtttccaatttccgtaaagagtttgaactctacaaagtgcgtgaaattaatgactatcatcatgcacatgatgcctatctcaatgctgtaattggaaaggctttactaggtgtttacccacaattggaacctgaatttgtttatggggattatcctcattttcatggacataaagaaaataaagcaactgctaagaaatttttctattcaaatattatgaacttctttaaaaaagatgatgtccgtactgacaaaaatggtgaaattatctggaaaaaagatgagtatatttctaatattaaaaaagtgctttcttatccacaagttaatattgttaagaaagtagaggagcaaacgggaggattttctaaagaatctatcttgccgaaaggtgattctgacaagcttattcctcgaaaaacgaagaaattttattgggataccaagaaatatggaggatttgatagcccgattgttgcttattctattttagttattgctgatattgaaaaaggtaaatctaaaaaattgaaaacagtcaaagccttagttggtgtcactattatggaaaagatgacttttgaaagggatccggttgcttttcttgagcgaaaaggctatcgaaatgttcaagaagaaaatattataaagttaccaaaatatagtttatttaaactagaaaacggacgaaaaaggctattggcaagtgctagggaacttcaaaagggaaatgaaatcgttttgccaaatcatttaggaaccttgctttatcacgctaaaaatattcataaagttgatgaaccaaagcatttggactatgttgataaacataaagatgaatttaaggagttgctagatgttgtgtcaaacttttctaaaaaatatactttagcagaaggaaatttagaaaaaatcaaagaattatatgcacaaaataatggtgaagatcttaaagaattagcaagttcatttatcaacttattaacatttactgctataggagcaccggctacttttaaattctttgataaaaatattgatcgaaaacgatatacttcaactactgaaattctcaacgctaccctcatccaccaatccatcaccggtctttacgaaacgcggattgatctcagtaagttaggaggagac

SEQ ID NO: 70 - DNA, 4134 bp, Streptococcus_agalactiae_NEM316
atgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagaggtagcaagtatcctatctttgcaacaatgcaggaggagaaatattatcatgaaaaatttccgacaatctatcatttgagaaaagaattggctgacaagaaagaaaaagcagaccttcgtcttgtttatctggctctagctcatatcattaaattcagagggcatttcctaattgaggatgatagatttgatgtgaggaataccgatattcaaaaacaatatcaagcctttttagaaatttttgatactacctttgaaaataatcatttgttatctcaaaatgtagatgtagaagcaattctaacagataagattagcaagtctgcgaagaaggatcgcatcttagcgcagtatcctaaccaaaaatctactggtatttttgcagaatttttgaaattgattgtcggaaatcaagctgacttcaagaaacatttcaatttggaggataaaacaccgcttcaattcgctaaggatagctacgatgaagatttagaaaatcttcttggacagattggtgatgaatttgcagacttattctcagtagcgaaaaagctatatgatagtgttcttttatctggcattcttacagtaactgatctcagtaccaaggcgccactttctgcctctatgattcagcgttatgatgaacatcatgaggacttaaagcatctaaaacaattcgtaaaagcttcattacctgaaaattatcgggaagtatttgctgattcatcaaaagatggctacgctggctatattgaaggcaaaactaatcaagaagctttttataaatatctgttaaaattgttgaccaaacaagaaggtagcgagtattttcttgagaaaattaagaatgaagattttttgagaaaacagagaacctttgataatggctcaatcccgcatcaagtccatttgacagaattgagggctattattcgacgtcaatcagaatactatccattcttgaaagagaatcaagataggattgaaaaaatccttacctttagaattccttattatgtcgggccactagcacgtgagaagagtgattttgcatggatgactcgcaaaacagatgacagtattcgaccttggaattttgaagacttggttgataaagaaaaatctgcggaagcttttatccatcgcatgaccaacaatgacctctatcttccagaagaaaaagttttaccaaagcatagtcttatttatgaaaaatttactgtttacaatgaattaacgaaggttagatttttggcagaaggctttaaagattttcaatttttaaataggaagcaaaaagaaactatctttaacagcttgtttaaggaaaaacgtaaagtaactgaaaaggatattattagttttttgaataaagttgatggatatgaaggaattgcaatcaaaggaattgagaaacagtttaacgctagcctttcaacctatcatgatcttaaaaaaatacttggcaaggatttccttgataatacagataacgagcttattttggaagatatcgtccaaactctaaccttatttgaagatagagaaatgattaagaagtgtcttgacatctataaagatttttttacagagtcacagcttaaaaagctctatcgccgtcactatactggctggggacgattgtctgctaagctaataaatggcatccgaaataaagagaatcaaaaaacaatcttggactatcttattgatgatggaagtgcaaaccgaaacttcatgcagttgataaatgatgatgatctatcatttaaaccaattattgacaaggcacgaactggtagtcattcggataatctgaaagaagttgtaggtgaacttgctggtagccctgctattaaaaaagggattctacaaagtttgaaaatagttgatgagctggttaaagtcatgggctatgaacctgaacaaatcgtggttgaaatggcacgtgagaaccaaacgacagcaaaaggattaagtcgttcacgacaacgcttgacaaccttgagagaatctcttgctaatttgaagagtaatattttggaagagaaaaagcctaagtatgtgaaagatcaagttgaaaatcatcatttatctgatgaccgtcttttcctttactacttacaaaacggaagagatatgtatacaaaaaaggctctggatattgataatttaagtcaatatgatattgaccacattattcctcaagctttcataaaagatgattctattgataatcgtgttttggtatcatctgctaaaaatcgtggaaaatcagatgatgttcctagcattgaaattgtaaaagctcgcaaaatgttctggaaaaatttactggatgctaagttaatgagtcagcgtaagtatgataatttgactaaggcagagcgcggaggcctaacttccgatgataaggcaagatttatccaacgtcagttggttgagactcgacaaattaccaagcatgtagctcgtatcttggatgaacgcttcaataatgaagttgataatggtaaaaagatttgcaaggttaaaattgtaaccttgaagtcaaatttggtttcaaatttccgaaaagaatttggattctataaaattcgtgaagttaatgattatcaccatgcacacgatgcttatcttaatgcagtagttgccaaagctattctaaccaaatatccacagttagagccagagtttgtctacggaatgtatagacagaaaaaactttcgaaaatcgttcatgaggataaggaagaaaaatatagtgaagcaaccaggaaaatgtttttctactccaacttgatgaatatgttcaaaagagttgtgaggttagcagatggttctattgttgtaagaccagtaatagaaactggtagatatatgagaaaaactgcatgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaaaggtaaagcacaaaaactaaaaacagttacggaacttttaggaattaccatcatggagaggtccagatttgagaaaaatccatcagctttccttgaatcaaaaggttatttaaatattagggacgataaattaatgattttaccgaagtatagtctgttcgaattagaaaatgggcgtcgtcgattacttgctagtgctggtgaattacaaaaaggtaacgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaggataataaggaaaatataccagtagatgaacttgctaataatattatcaatctatttacttttaccagtctaggagctccagcagcttttaaattttttgataaaatagttgatagaaaacgctatacatcaactaaagaagtacttaattctactctaatccatcaatctattactggactttatgaaacacgtattgatttgggtaaattaggagaagattga

SEQ ID NO: 71 - DNA, 4116 bp, Streptococcus_dysgalactiae_subsp._equisimilis_AC-2713
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttgacagtggagagacagcggaagcgactcgtctcaaacggacagctcgtagaagatatacgcgccgaaagaatcgtattcgttatttgcaggaaatctttagcagtgagatgtccaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatatggacaaactatttatccagttggtacaaacctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggcgaaactaaatcgtgaagatttgctgcgcaagcaacggacctttgacaacggctctattccccatcaaattcacttgggtgagctgcatgctattctgagaagacaagaagacttttatccatttttaaaagacaatcgtgagaagattgaaaaaatcttgacctttcgaattccatattatgttggcccattggcgcgtggaaatagtcgctttgcatggatgactcggaagtctgaagaaacgattactccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagaatttctttcaggaaagcagaaagaagccattgttgatttactcttcaaaacaaatcgaaaagtaaccgttaagcaattaaaagaagattatttcaaaaaaatagaatgttttgatagcgttgaaatttcaggcgttgaagatcggtttaatgcgtcattaggtacctaccatgatttgctaaaaattatcaaagataaagattttttggataatgaagaaaatgaagatattttagaggatattgttttaacattgaccttatttgaagataaggaaatgattgaggaacgacttaaaaagtatgctaacctctttgatgataaggtgatgaaacagcttaaacgtcgccattatactggctgggggcgtttgtctcgaaaattgattaatggaattagggataagcaatctggtaaaacaatattagattttttgaaatcagatggttttgccaatcgcaactttatgcagcttatcaatgatgatagtttaacattcaaggaagctattcaaaaagcacaggtgtctggacaaggccatagtttacatgaacagatagctaacttagctggcagtcctgctattaaaaaaggtattttacagtctgtaaaagttgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctgaatgccgtcgttggaactgctttgattaagaaatatccaaaactagaatcggagtttgtctatggtgattataaagtttatgatgttcgtaaaatgattgctaagtctgagcaggaaataggcaaagcaaccgcaaaacgtttcttttattctaatatcatgaactttttcaaaacagaaattacacttgcaaatggagagattcgcaaacgccctctaatcgaaactaatgaggaaaccggagaaattgtctgggataaagggcgagattttgccacagtgcgcaaagtattgtccatgccacaagtcaatattgtcaagaaaacagaagtacagacaggtgcactgactaatgaatcaatttatgctagaggaagttttgataaattaatcagtcgtaaacatcgttttgagtcctctaaatatggaggatttggcagcccgactgttacttatagtgtgttagtagttgcgaaatccaaagttcaagatggaaaagtaaaaaaaataaaaactggaaaagaattaattgggattacattattagataaactagtttttgaaaaaaatccattaaaatttattgaagataagggatacggaaatgttcaaattgataagtgcattaagttacctaaatatagcctctttgaatttgaaaatggcactcgaagaatgcttgctagtgttatggcgaataataatagcaggggagatttgcaaaaagcaaatgaaatgtttttaccggcgaagttggtaacactgctataccatgcacacaaaattgagagttctaaagaattggagcatgaagcatacattttggaccactataatgatttgtatcaattgctgagctatatagaacgatttgcttcattatacgtggatgttgaaaagaacatttctaaagtaaaagaacttttcagcaacattgaaagctattctatttctgaaatttgttcctccgttattaatttattaacacttacagcatccggtgctcctgcagattttaaattcttaggcacaacaattccacgaaaacgttatggttctccccagtctattctcagttctacccttatccatcaatccatcactggtctttatgaaacacgcattgatttgagtcagttaggaggtgactaa

SEQ ID NO: 72 - DNA, 4116 bp, Streptococcus_gallolyticus_subsp._gallolyticus_ATCC_43143
atgactgagaaaaattattcaatcggacttgatattggtacgaacagtgttggttgggctgtgattactgatgattacaaggttccagctaaaaaaatgaaagttttaggaaatactgataaaaagtatattaagaaaaatttattgggagccttattgtttgataatggcgaaacagcagaagctactcgcttaaagcgtactgctagacgacgttacacacgccgcaaaaatcgtttacgttacctacaagaaatttttgcggaagaaatggctaaagttgatgaaagcttcttttatcgtcttgatgaatcatttttgacaacagatgataaagatttcgaacgtcatccaatttttggaaataaagcagatgaaataaaatatcatcaagaatttccaaccatctatcacttgcgaaaacatcttgctgactctcatgaaaaagcagatttacgtttaatctatcttgctttagcacacatgattaaattccgtgggcattttttaattgaaggtgaattgaatgctgaaaatacagatgttcaaaaattattcgaagcttttgttgaagtgtatgatagaacctttgatgacagtaacttatcagaaattacggttgatgcttcaagtattctaacagaaaaatttagcaaatcacgtcgtttagagaatcttattaaacactatccgacagaaaagaagaataccttatttggaaatcttgttgctttagctctaggattacaaccaaactttaaaacaagttttaaactatctgaagatgctaaattgcaattttctaaagatacttatgaagaagatttagaagagttgattggaaaaattggtgatgagtatgcggacttatttacatcagctaaaaatctttatgatgctattttgttgtcaggaattttaacagtagctgataataccacaaaagctccactatcagcttcaatgattaagcgttacaatgaacatcaagtagatttaaaaaaattaaaagaatttatcaaaaataatgcttctgataagtatgatgaaattttcaatgataaagataagaatggttatgctggttacattgaaaatggagtcaaacaagacgaattctataaatatttaaaaacaacactttctaaaattgatggaagtgattatttccttgacaaaattgaacgtgaagattttttaagaaaacaaagaacatttgataatggttcaattccgcatcaaattcatttacaagaaatgcatgctattttacgtcgtcaaggtgagcattatgcattcttgaaagaaaaccaagctaagattgaaaaaatcttaacctttagaattccttactatgttggtccattggcacgaaaaaatagtcgatttgcatgggcagagtatcattctgacgagaagattacaccgtggaattttgatgagattatagacaaagaaaagtcagccgaaaaattcattacacgcatgactttaaatgatttgtatttacctgaagaaaaggttctaccaaaacatagtcttgtttatgaaacttatactgtttataatgaattgacaaaagttaagtacgttaatgaacaaggcaaatcaaacttttttgatgcaaatatgaagcaggaaatttttgaacatgtctttaaagaaaatcgtaaagtcactaaagataaatttctaaactatcttaataaagaatttcctgagtatcgtattcaagatttaatcgggcttgataaagaaaataaatcattcaatgctagtcttggaacttaccatgatttgaaaaagattttggacaagtcattcttagacgataaaactaatgaaacgataattgaagatattatccaaacattgactttatttgaagatagagatatgattcgtcagcgtcttcaaaaatatagcgatatctttacaccacaacaattgaaaaaattggaacgccgtcattatacaggatggggacgtttatcatataaattgattaatggtattcgaaataaagaaaatgggaaatcgattcttgattatttaattgatgatggttatgctaaccgtaattttatgcaattaattagcgatgatacgttgccatttaaacaaattattaaagacgcacaaattattggtgacattgatgatgttacaagtgtagtacgcgaattacctggaagtcctgctatcaaaaaaggtatcctacaaagtgtcaaaatcgttgatgagctagttaaagtgatgggacataatcctgataatattgtcattgagatggcgcgtgaaaatcaaacaactaatagaggaagaaatcaatctcaacaacgtttgaaaaaacttcaggactcattaaaagaattaggaagtaatatccttaatgaggaaaaaccatcgtatattgaaggtaaagttgaaaacaaccacctccaagatgatcgtctattcctttattacattcaaaatggtaaggatatgtacactggtgatgagttagatattgaccatctaagtgattatgatattgaccacatcattcctcaagcctttattaaggatgactcaattgataatcgagtattgacaagttctgctaagaatcgaggtaaatcagatgatgtaccaagtcttgatattgttcatgatagaaaggcagattggattagattatacaaatctgggttaatttctaagcgtaaatttgataatttgactaaagcagaacgtggtggtttgactgaaaatgataaagcaggatttattaagcgtcaattggttgaaacacgtcaaattacaaaacatgtagcgcaaattttagatagtcgttttaatactgaacgtgatgaaaatgataaagtaattcgtaatgttaaagttattactttgaaatcaaatctagtttcacaattccgaaaagattttaaattttataaggttcgagaaattaatgattatcatcatgctcatgatgcgtatctcaatgcagttgttggaacagcgttattgaaaaaatatcctaaattagctcctgaatttgtttatggtgagtacaagaaatatgatattcgtaaatttatcactagttcaggtgataaagcaacagcaaaatatttcttctattcaaatttgatgaatttctttaaacgtgttataagatattcaaatggtaaggtagtagttcgaccggttattgagtgtagcaaggatactggtgaaattgcttggaacaagcaaactgactttgaaaaagttcgaagggttctttcttatccgcaagttaatattgttaaaaaagttgaaactcaaacgggtggattttcaaaagaatctattctacctaagggaaattctgataaactaattccacgaaaaacaaagaaattccgctgggatactccaaaatatggaggatttgatagcccaaacattgcttactctgtttttgttatagctgatgttgaaaaaggcaaggctaaaaaattgaaaactgtaaaagaattggtgggaatatcaattatggagcgctcttcctttgaagaaaatccagttgtatttttagaaaagaaagggtatcaaaatgttcaagaggataacttgataaaacttcctaaatatagtctttttgaatttgaaggcggaagaagacgtttattagccagtgcttcagaacttcaaaagggaaatgaagtagtactttcacgtcatttagtagaattactttatcatgctcatcgagttaatagttttaataactctgaacatttgaaatacgttagtgagcataagaaagaatttggagaagtcttatcttgtgtagaaaattttgctaagtcatacgttgacgttgaaaaaaatcttggcaaaattagagcagttgctgataagatagatacattctcaattgaagatatttcaatatcatttgtcaatttattaacattgactgcactaggagcaccagcagattttaacttcttaggtgaaaaaattccacgtaaacgttatacttcaaccaaagaatgtctaaatgccacccttatccaccaatctatcactggtctttatgaaacacgtattgatttgagtaaattaggagaagagtaa

SEQ ID NO: 73 - DNA, 3411 bp, Streptococcus_gordonii_str._Challis_substr._CH1
atgaacggtttagttttaggtttagatattggtattgcctctgtaggggtggggattctagaaaaagatacggggaagatcattcatgctagttctcggctttttccagctgcaactgccgacaataatgtcgaaagaaggagtaatagacagggaagacgattaaatcgcaggaaaaaacaccgtagtgttaggcttcaggatctatttgaaggctatggtttgttaactgatttttctaaagtgtcaatgaatttaaatccttatcaacttcgtgtacaaggaatggagaatcaactcacaaacgaagagttgtttgttgcattgaagaatattgttaaaaggcgtggtattagctatttagatgatgcttctgaggatgggggtacagtatcgtctgattatggtaaggcagttgaagaaaatagaaaattacttgctgaaaagacacctggtcaaatccaactagagcgttttgaaaaatatggtcaattaaggggagattttactgttgaagaaaatggtgaaaaacatcgattgatcaatgtcttttcaacatctgcttatagaaaagaagctgaaagaattcttagaaaacagcaagaatttaatagtaaaattactgatgagtttatagaggattatttaataatccttacagggaaaagaaaatattatcatggaccaggtaatgaaaaatctcggacagattatggacgttttcgaacagatggtactaccttagataatatttttggtattttaattggcaaatgtacattttatactgaggaatatagagcttcaaaagcctcctatactgctcaagagtttaatttactaaatgatttaaataatttaacagttcctacagagaccaagaaacttagtgaggaacaaaagaagctaatcattgaatatgcaaagtcggcgaaaacattaggagcttcaactttattgaagtacattgctaaaatgattgatgcttcagtagatcagatacgtggttaccgagttgatgtaaataataaacctgaaatgcatacttttgaagtctatcggaaaatgcaatctttagaaacgataaaagttgaagaattgcctagaaaagttctagatgagcttgctcatattctaactttgaatacagagcgagaaggtatagaagaagcgattaactcgaagttaaaggatatatttaatcgagatcaagtacttgaattggttcaatttagaaaaaataatagcagtctatttagtaaaggatggcataatttttctattaaactcatgatggagttgataccagaactttatgaaacttcagaagagcaaatgacaattctcacacgattgggaaaacaaagatctaaagagacatcaaaacgaactaagtatattgatgaaaaagaattaacagaagaaatctataatcctgtagtagcaaaatctgttagacaggccataaagataatcaacgaagcaactaaaaaatatggtatctttgataatatcgttatcgaaatggcccgtgaaaataacgaagaagatgctaagaaagattatataaaacgtcaaaaagcaaaccaagatgagaagaatgcggctatggaaaaagcagcgtttcaatacaatggtaaaaaagagttaccagataacatttttcatggccataaggaattgactactaagattcgtttatggcatcaacagggagaaaagtgtctctatactgggaagaatattccaatttcagatttaatccacaatcagtacaagtacgaaatcgatcatattttacctttatctctatcttttgatgatagtttatctaataaagtattagttctagctactgcaaaccaagaaaagggacaacgaacaccgtttcaggctttagatagtatggatgatgcatggtcctaccgtgagtttaaatcatatgtaaaagattcaaaattattaagtaataaaaagaaagattatcttttaacagaagaagacattagtaaaattgaggtgaagcagaagtttattgaacgaaatctagttgatactagatattcttctcgagttgttttaaatgccttgcaagatttttataagagccatcaattggatacaactatttcggtggtacgtggacaatttacctctcagctaaggagaaagtgggggattgaaaaatctcgtgagacctaccaccatcatgctgtggatgcattaattattgctgcttccagtcaattaagattatggaaaaaacatagtaatcctctgattgcttataaagaagggcaattcgttgattcagagactggagaaatcgtttcattaagtgatgaagaatacaaagagttagtatttaaagcaccttatgatcattttgttgacacattacgtagtaagaagtttgaggatagcattttgttttcatatcaagtggattcaaaatataaccgtaaaatttcagatgcgaccatttatgcaacaagaaaagcaaaattggataaagagaaaaaagaatatacttatactttggggaaaataaaagatatctatgctttagggacaaaaactccgtctaaaacaggattttataagtttttagatttatacaagacggataaatctcaattcttaatgtatcagaaggataggaaaacttgggatgaagtaatagagaagataattgaacaatatcgaccatttaaagaatatgacaaaaatggaaaagaggttgatttcaatccttttgaaaaatatagaattggaaatggtcctattcggaaatatagtaaaaaagggaatggtccagaaattaaaagtctgaaatactacgatatattattaggtaaacacaaaaatataactcctgatgggagtcgaaatactgtagctttgttatctttaaatccttggagaacagatgtttactacaattcggaaactaaaaaatatgaatttttgggattaaagtatgcagatttgtgtttcgaagaggggggagcctatggtatttctgaagttaagtataaaaagataagagagaaagaaggaattggtaagaattctgaatttaagtttaccctgtataagaatgatttaattttaattaaagatactgaaacgaattgtcaacaattctttagattttggtctcgtactgggaaagataatccaaaaagttttgaaaaacataaaatagaattgaaaccttatgaaaaagcaaaatttgagaaaggagaagaacttaaagtattaggaaaggtaccaccttcctctaatcaattccaaaaaaatatgcaaatagaaaatctttctatttacaaagtcaaaacagatattttaggaaataaacatttcatcaaaaaagagggtgatgaaccaaaactcaaatttaaaaaataa

SEQ ID NO: 74 - DNA, 4035 bp, Streptococcus_mutans_GS-5]; identical to SEQ ID NO: 69

SEQ ID NO: 75 - DNA, 3384 bp, Streptococcus_salivarius_JIM8777
atgagcgacttagttttaggacttgatatcggtataggttctgttggtgtaggtatccttaataaagtgacgggagaaattatccataagaactcacgcattttcccagcagctcaagcggagaataatgtagaacgtagaataaatcgtcaaggaagacgattgacacgacgtaaaaaacatcgtagagttcgtttaaatcatttatttgaagaaagtggcttaatcactgattttacaaatgtttcaatcaatcttaacccatatcaattgcgagttaagggtttgaccgatgaattgtctaatgaagaattgtttatcgctcttaaaaatatggtgaaacaccgtgggattagttaccttgatgatgccagtgatgacgggaattcatcagtaggcgactatgcacaaattgtcaaagaaaacagtaaacaattagagacaaaaacaccaggccagattcaattggaacgctaccaaaaatatggtcaattacgtggtgatttcacagtcgaagaagatggaaaaaaacatcgcttaattaatgtctttcccacatcagcttatcgagcagaagcactgagaatactgcaaactcaacaagaatttaatccacagattaccgatgaatttattaatagttatctccaaattctaactggaaaacgtaaatattatcacggaccaggaaatgagaagtcacggactgattatggaaggtatactactaagaaagattctgaagatgagtacataactttagacaatatttttggaatcctaattgggaaatgtacattttatccggaagagtatagagcagcaaaagcatcctatacggctcaagaattcaatttgctaaatgatttgaacaatctaaccgttccaacagaaaccaagaagttgagcgaagaacagaagaatcaaatcattaccaatgtcaaaaatgaaaaggcgatgggtccagcgaaactctttaaatatatcgctaagctactttcttgcgatgttgcggatatcaaaggataccgtatcgataaatcagataaggctgaaattcatactttcgaagcctatcgaaaaatgaagacgcttgcaaccattgatattgagcaaatggagagagaaaatcttgataagttagcctatgtcttaacattaaatacggagaaggaaggtatccaagaagcgttagagcatgagtttgctgatgggaccttcagtcaggagcaaattgatgaattggttcaatttcgcaaagcaaatagttctatttttggaaaaggttggcacagtttttctgtcaaacttatgatggaattaatcccagaattatatgcgacgtcagaagaacaaatgactattctgacacgactaggaaaacaaaaaacaacttcgtcttcaaataaaaccaaatatattgatgagaaacaactaactgaagaaatctacaatcctgttgctgctaagtctgttcgccaagctataaaaatcgtaaatgcggcaatcaaagagtatggtgattttgacaatattgtcatcgaaatggctcgagaaacgaatgaagatgatgaaaagaaagctattcaaaagattcaaaaagctaataaagatgaaaaggatgcagccatgcttaaggctgccaaccaatataatggaaaggctgaattaccacatagtgttttccatggtcataagcaattagcaaccaaaatccgtctctggcatcagcaaggagaacgttgcctttatactggtaaaacaatttcgattcatgatttgatcaataattctaatcagtttgaaatagatcatattttacctctttcgatcaccttcgatgacagccttgccaataaggttttggtttatgcaactgctaaccaagaaaaaggacaacgaacaccttatcaggctttagatagcatggatgatgcatggtctttccgtgaattaaaagcttttgtacgtgactcaaaagcactttcaaacaagaaaaaagaataccttcttacagaagaggatatttcaaaatttgatgttcgaaagaaatttatcgaacgaaatcttgtagatacaagatacgcttcaagagttgtcctcaatgcccttcaagaacactttagagttcacaagactgatacaaaagtttccgtggttcgtggtcaattcacatctcaattgagacgccattggggaatcgagaagactcgtgatacttatcatcaccatgctgtagatgcactgatcattgctgcttcaagtcagttgaatttgtggaaaaaacaaaagaatactcttgtaagttattcagaagatcaactacttgatattgaaacaggtgaacttattagtgacgatgaatacaaggaatctgtattcaaagctccttatcaacattttgttgatacattgaagagtaaagagtttgaagacagtatattgttctcatatcaagtggattctaagtttaatcgtaaaatatcagatgccactatttacgcaacaaggcaggctaaagtaggaaaagataagaaagacgaaacttatgtcttagggaaaattaaagatatctatagccagactggctatgatgcttttataaagatttataagaaagataagtcaaaattccttatgtatcgacacgatccacaaacctttgagaaagttatcgaaccaattttagagaactatcctaacaaggagctgaatgaaaaagggaaagaagtaccttgtaatcctttcctaaaatataaagaagaccatggctatattcgtaaatatagtaaaaaaggcaatggtcctgaaatcaagagtcttaaatactatgatagtaagttaggtaatcatattgatatcactccaaagaatagtaacaataaggttgtcttgcagtcagtttctccatggagagcggatgtctatttcaataagactactggaaaatacgaaatccttggattgaaatatgctgatctaaaatttgagaaagggacaggaacatataagatttccgaagaaaaatacaatgacattaagataaaagagggtgtagattctgattcagaatttaagttcacactatataaaaatgatttgttgcttatcaaagatacggaaacaaaagaacaacagctttttcgttttctttctcgaaccatgcctaatgtgaaacattatgtagaattaaaaccttatgataaacagaaatttgatgataatgaagagcttatcaaaattttaggaattgttgctaaaggaggacaatgtaaaaaaggggtaagtaaacccaatatttccatttacaaaataagaacggatgtcctagggaatcagcatatcatcaaaaatgagggtgataagcctaagctagatttttaa

SEQ ID NO: 76 - DNA, 3369 bp, Streptococcus_suis_D9
atgtcaaacggtaaaattttaggccttgatattggtattgcttccgtcggagtaggcgtcatagatgcacaaacgggagaaatcattcatgcaagctctcgtatttttccctctgcaaatgctgctaataatgcagaacgccgaacttttcgtggaagtcgtcgattgattaggagaaaaaaacatagaattaaaagattagatgatttatttaatgattttcatattaatttagatggagaaatgtcgacagataatccatatgttcttcgcgtgaaaggcctctctcaaaaactaacagttgaagaattatatatttctataaagaatattatgaagcgcagggggatatcctatctagatgatgcagagtcagataacgaggcgggaagaagtgattatgctaaagctatcgagcgtaatagacagttattgactagtaaaacaccaggggaaattcagttagagcgcttagagaaatacggtcagttgcgtggaaatttcacgataattgatgaggaggggcaatctcaacaaattatcaatgttttttcaacatcagattatgtcaaggaagttgagaaaattttagattgtcaaaaaatgtatcataaatttatatctgatgaattttgcgataagctgatcgaactattaagagaaaaaagaaagtattatgttggtccagggaatgagaaatctagaactgactatggtatttatagaacagatgggacaactctagagaatttatttggaattcttattggtaaatgtacattttatccagatcaatatcgttcttcgagagcgtcctatacagcacaagaatttaattttttaaatgatttaaacaatttaacagtacctactgaaacgaaaaagttaagtcaggaacaaaaagaatttttagtaaattatgctaaagaaacgtcggtattaggggctggaaaaatattgcaacaaattgcgaaacttgcggattgtaaggttgaagatattagggggtatcgtttagataataaggataaacccgaactacatacctttgaaacatatcgagcaatgaaaggtctagttccgttagtagacattggagtattgtcgagagagcagcttgatatattagccgatattctaacccttaatactgattttgaaggaattagagaggccctaaaaaaacaattgccaaatgtatttgatgaaaaacaggtcaaggggttagcaagttttagaaagtcgaaaagccaattatttgcaaaaggctggcacaatctatctcaaaaaattatgctagaggtaattccagaattatatgcaacatctgatgaacaaatgacaatcttaacacgattaggaaagtttgagaagagtagtgttgctgaatatccttcctcaattaatgtagatgagattacagatgaaatatataatccagtcgttgctaaatctatccgtcaaaccattaaaattatcaatgcttcgataaaaaaatgggatgaatttgatcaaattgttatagagatgcctcgtgatcggaatgaagatgaagagaagaagcgaattgcggatggacagaaagcaaatgcaaaagaaaaagcggattcaatcctacgtgcggcagaattgtattgtgctggaaaggtattgccagattatgtctataatggacacaatcagttagcaacaaaaattcgtctctggtatcaacaaggagagcgttgtatttatactggtcagccgatctcaattcatgatttaattcataatcagaatcagtatgaaattgaccatatcttgccactttctttgacatttgatgatagtttatcgaataaggttttagttcttgcaactgcaaaccaagagaaagctcaacgtacaccgtataattatctgaaaagtgctacgtcagcttggtcctatcgtgaatttaaggactatgttactaagcgcaaaggaattgggaagaagaaatgtgaatatctgacatttgaggaagatattaatggatttgaggtgagaagtaagttcattcagcgtaacttagtggatactcgatacgcctctaaagtcattctaaatgccttacaagattatttcaaaatatcagggatacaaacgaaagtttctgttgtaagaggtcaatttacatctcaattgcgtcataaatggggaattgaaaagacacgtgaaacgtatcatcaccatgcggtggatgccttaattattgcagcatcaagtcaattaagactctggaaaaagcaagaaagcccgcttgttgttgattaccaggaaggacgtcaagtagacttagaaactggagaaatcttagaattgacagatgagcaatataaagaacttgtctatcaaccgccgtatcaaggatttgtaaatactatctctagctcggcttttgataatgagatactgttttcttaccaagtagactccaaggtgaatcgtaaaatttctgatgcaaccatttatgcaactcgtaacgcacaacttggaaaagataaaacggaagggatatatgtccttggaaaaatcaaagatatctatacacaagctggatatgaggcatttttgaaacgttatacgaaggacaaaacttcttttctaatgtatcataaagaccttgatacttgggaaaaagtgattgagattattttacgtgactatagagaatatgatgaaaaagggaaagaaataggtaacccatttgaaagatatcgtagggaaaatggttatgtgaaaaaatatagccgtaaaggaaatggtactgcaataaaatcattaaaatactatgataataagcttggaaatcatatcgatattactccagaaaatagtcgaaatgcggtagtattgcagtcattaaaaccttggaggacagatgtatattttaataaagaaacaggcaagtatgaattcttggggattaaatattctgatctatcgttcgaaaaaggtactggagagtatggcataagtcaagaaaagtatgattcaataaaaatagcagaaggagttgcaaaaaaatcgatatttaaatttacactttataaacaagatttattattcataaaagatattgaaaataactttggaaaattacttagattcacttctaaaaatgatacaagcaaacattatgttgaattaaagccttatgataagaataagtttggtacagaggagccactgttaccagtgctaggaaatgttgccaaaagcggacaatgtataaaaggtcttaacaaatcaaatatatctatttataaagtacggacagatattttaggctatcgacactttataaaacaagagggagaacaccctcaattaaaatttaaaaaataa

SEQ ID NO: 77 - DNA, 3369 bp, Streptococcus_thermophilus_LMG_18311
atgagtgacttagttttaggacttgatatcggtataggttctgttggtgtaggtatccttaacaaagtgacaggagaaattatccataaaaactcacgcatcttcccagcagctcaagcagaaaataacctagtacgtagaacgaatcgtcaaggaagacgcttgacacgacgtaaaaaacatcgtatagttcgtttaaatcgtctatttgaggaaagtggattaatcaccgattttacgaagatttcaattaatcttaacccatatcaattacgagttaagggcttgaccgatgaattgtctaatgaagaactgtttatcgctcttaaaaatatggtgaaacaccgtgggattagttacctcgatgatgctagtgatgacggaaattcatcagtaggagactatgcacaaattgttaaggaaaatagtaaacaattagaaactaagacaccgggacagatacagttggaacgctaccaaacatatggtcaattacgtggtgattttactgttgagaaagatggcaaaaaacatcgcttgattaatgtctttccaacatcagcttatcgttcagaagccttaaggatactgcaaactcaacaagaatttaattcacagattacagatgaatttattaatcgttatctcgaaattttaactggaaaacggaaatattatcatggacccggaaatgaaaagtcacggactgattatggtcgttacagaacgaatggagaaactttagacaatatttttggaattctaattgggaaatgtacattttatccagacgagtttagagcagcaaaagcttcctacacggctcaagaattcaatttgctaaatgatttgaacaatctaacagttcctactgaaaccaaaaagttgagcaaagaacagaagaatcaaatcattaattatgtcaaaaatgaaaaggtaatggggccagcgaaactttttaaatatatcgctaaattactttcttgtgatgttgcagatatcaagggacaccgtatcgacaaatcaggtaaggctgagattcatactttcgaagcctatcgaaaaatgaaaacgcttgaaaccttagatattgagcaaatggatagagaaacgcttgataaattagcctatgtcttaacattaaacactgagagggaaggtattcaagaagctttagaacatgaatttgctgatggtagctttagccagaagcaagttgacgaattggttcaattccgcaaagcaaatagttccatttttggaaaaggatggcataatttttctgtcaaactgatgatggagttaattccagaattgtatgagacgtcagaagagcaaatgactatcctgacacgacttggaaaacaaaaaacaacttcgtcttcaaataaaacaaaatatatagatgagaaactattaactgaagaaatctataatcctgttgttgctaagtctgttcgccaggctataaaaatcgtaaatgcggcgattaaagaatacggagactttgacaatattgtcatcgaaatggctcgtgaaacaaatgaagatgatgaaaagaaagctattcaaaagattcaaaaagccaacaaagatgaaaaagatgcagcaatgcttaaggctgctaaccaatataatggaaaggctgaattaccacatagtgttttccacggtcataagcaattagcgactaaaatccgcctttggcatcagcaaggagaacgttgcctttatactggtaagacaatctcaatccatgatttgataaataatcctaatcagtttgaagtagatcatattttacctctttctatcacattcgatgatagccttgcaaataaggttttggtttatgcaactgctaaccaagaaaaaggacaacgaacaccttatcaggctttagatagtatggatgatgcgtggtctttccgtgaattaaaagcttttgtacgtgagtcaaaaacactttcaaacaagaaaaaagaatacctccttacagaagaagatatttcaaagtttgatgttcgaaagaaatttattgaacgaaatcttgtagatacaagatacgcttcaagagttgtcctcaatgcccttcaagaacactttagagctcacaagattgatacaaaagtttccgtggttcgtggccaatttacatctcaattgagacgccattggggaattgagaagactcgtgatacttatcatcaccatgctgtcgatgcattgattattgccgcctcaagtcagttgaatttgtggaaaaaacaaaagaatacccttgtaagttattcagaagaacaactccttgatattgaaacaggtgaacttattagtgatgatgagtacaaggaatctgtgttcaaagccccttatcaacattttgttgatacattgaagagtaaagaatttgaagacagtatcttattctcatatcaagtggattctaagtttaatcgtaaaatatcagatgccactatttatgcgacaagacaggctaaagtgggaaaagataagaaggatgaaacttatgtcttagggaaaatcaaagatatctatactcaggatggttatgatgcctttatgaagatttataagaaggataagtcaaaattcctcatgtatcgtcacgacccacaaacctttgagaaagttatcgagccaattttagagaactatcctaataaggaaatgaatgaaaaagggaaagaagtaccatgtaatcctttcctaaaatataaagaagaacatggctatattcgtaaatatagtaaaaaaggcaatggtcctgaaatcaagagtcttaaatactatgatagtaagcttttaggtaatcctattgatattactccagagaatagtaaaaataaagttgtcttacagtcattaaaaccttggagaacagatgtctatttcaataaaaatactggtaaatatgaaattttaggactgaaatatgctgatttacaatttgaaaagaagacaggaacatataagatttcccaggaaaaatacaatggcattatgaaagaagagggtgtagattctgattcagaattcaagtttacactttataaaaatgatttgttactcgttaaagatacagaaacaaaagaacaacagcttttccgttttctttctcgaactatgcctaatgtgaaatattatgtagagttaaagccttattcaaaagataaatttgagaagaatgagtcacttattgaaattttaggttctgcagataagtcaggacgatgtataaaagggctaggaaaatcaaatatttctatttataaggtaagaacagatgtcctaggaaatcagcatatcatcaaaaatgagggtgataagcctaagctagatttttaa

SEQ ID NO: 78 - DNA, 4188 bp, Treponema_denticola_ATCC_35405
atgaaaaaggaaattaaggattattttctcggattggatgtaggaaccggatcggttggttgggcagttactgatactgactataaactcttaaaggctaatcgtaaagacctttggggaatgaggtgttttgagacggcggaaactgcggaagtgagaaggcttcacaggggggctaggcgccgtattgagagaagaaaaaaaagaataaagctgcttcaagagcttttttcccaagaaattgcaaaaacagatgagggatttttccaaagaatgaaggaaagccctttctatgcagaagacaagactatattacaggaaaacactctttttaatgataaagattttgccgataagacctaccataaagcctatcctaccataaaccatctgataaaggcttggattgaaaacaaggtaaagccggatccaaggttattatacttagcctgtcataatattataaaaaaaagaggtcattttttattcgagggcgatttcgattcagaaaatcagtttgatacttctatacaagccctttttgaatatctgcgtgaagatatggaagtcgatattgatgccgatagccaaaaagtaaaagagattttaaaggatagctctttaaaaaattccgaaaaacaaagccgcctaaataagattttaggactgaaaccctccgacaaacaaaaaaaagctattactaatttaatatcaggcaacaaaataaactttgccgatctttatgataatccggatttaaaggatgcggagaaaaatagtatatctttttcgaaagatgattttgatgctttgagtgatgatcttgcttccattctaggagattcttttgagcttttattaaaagcaaaggctgtatataactgctcggttctttccaaggtaataggcgatgaacagtatctttcttttgcaaaggtaaaaatatatgaaaagcataaaaccgatttgactaaattaaaaaatgttataaaaaagcatttcccaaaagattataaaaaagtattcggatacaataaaaacgaaaaaaataacaacaattactccggatatgtaggcgtatgtaaaaccaagagtaaaaaactaattataaacaattctgtaaatcaagaagatttttacaaatttttaaaaactatcctttcagcaaaatccgagataaaggaagtaaatgatatattgaccgaaattgaaacagggacttttttacctaaacagatatctaaaagcaatgcggagattccttatcaattacgcaagatggagctggaaaaaatattatcaaacgcagaaaaacatttttcctttttaaaacaaaaagatgaaaaaggtttatctcacagtgaaaagattataatgcttttaacatttaagattccttattatattggacctataaacgataaccataaaaaattttttcccgatagatgctgggtagtaaaaaaagaaaaatcgccttccggtaaaactactccatggaacttttttgatcatatcgataaagaaaaaacagctgaagcatttattacaagcagaaccaatttttgcacatatttagtaggggaatccgttttaccaaaaagttctcttttatattccgagtataccgttttaaatgaaatcaacaatttacagattatcattgacggaaaaaatatctgcgatattaaactaaaacaaaaaatatacgaagatttatttaaaaaatataaaaagattacacaaaaacaaatttcaacttttatcaaacacgaaggtatttgcaataaaactgatgaagtaattattctaggtatcgataaagaatgtacatcttcgttaaaatcatatatagaacttaaaaacatattcggaaagcaagtagatgaaatttctacaaagaatatgcttgaagaaattatacgatgggctactatctatgatgaaggagaaggcaaaacaatacttaaaacaaaaataaaagccgaatatggaaaatattgttctgatgaacagatcaaaaaaattctaaatcttaaattttcaggttggggccgcttgtcacgcaaattccttgaaaccgtcacatcagaaatgccgggttttagcgaaccggtaaatataataactgcaatgcgggaaactcaaaataatttaatggagttgcttagcagtgaatttacatttactgaaaatattaaaaagataaattcgggatttgaagatgctgaaaagcaattttcatatgacggtttggttaagcctctgtttttatcaccatcggtaaaaaaaatgttgtggcagactctaaagcttgtaaaagaaatatcgcatattacccaagcccctcctaaaaaaatatttatagaaatggcaaagggtgcagagcttgaacctgcgaggactaagacaagattaaaaattttacaagacttatacaataactgtaaaaatgatgcggatgcttttagttccgagataaaagacctttcaggtaaaatagaaaatgaagataatttaaggcttcgaagcgacaaactttatctttattacacgcagcttggaaagtgcatgtattgcggtaaaccgattgaaataggccatgtatttgatacaagcaactatgatatagatcatatttatccccaatccaagattaaagatgacagtataagtaatcgggttttagtatgcagcagctgcaataaaaataaggaagataaatatcctttgaagtctgaaattcaatcaaagcaaaggggcttttggaattttttacaacgaaataactttataagccttgaaaaattgaataggttaacaagggccactccaatctcggatgacgaaacggcaaaattcattgccagacagcttgtagaaacaagacaggcgacaaaagtagctgcaaaagtattagaaaaaatgtttcccgaaactaagattgtttattctaaagctgaaaccgtatcaatgtttagaaataaattcgatattgtaaaatgcagagaaataaacgattttcatcatgctcatgatgcatatttaaatattgttgtcggaaatgtatataatacaaaatttacaaataatccttggaactttataaaggagaaacgggataatccaaagattgccgatacttacaattattataaagtttttgattatgatgtaaaaagaaataatattacggcatgggaaaaaggaaaaacaattatcactgtgaaggatatgcttaaaagaaatacccctatttatacacgccaagccgcctgcaaaaaaggagaactctttaaccaaaccattatgaaaaaaggattgggccagcatcctctaaaaaaagaaggtcctttttctaatatttcaaaatatgggggctataataaagtctctgctgcatattatactcttatagaatacgaagaaaaagggaataaaatacgaagcttagaaaccatccctctatatttggtaaaagacattcaaaaagatcaagatgtattaaagagttacttaacagatctgctagggaaaaaagaatttaagattttggttcctaaaataaaaatcaactccctcttaaaaattaacggtttcccttgtcatataacagggaaaaccaatgattctttcttactgcgtccggctgttcagttttgctgttcaaataatgaagttctttattttaaaaaaattataagattcagtgaaataagaagtcaaagagaaaagataggaaaaacaatttctccttatgaagacttatcctttagatcttatatcaaagaaaatttatggaaaaagacaaaaaatgatgaaataggagaaaaggagttttatgaccttcttcaaaagaagaatttggaaatctatgatatgcttttaacaaaacataaggatactatttataaaaaaagacctaactctgcaactattgatatcttagtcaaaggaaaagaaaagtttaaatctttaataatcgaaaatcagtttgaagttattttagagattttaaaactgttttctgccactagaaatgtatcagacttacaacatataggcggaagcaaatattcaggagttgcaaagataggaaataaaatatctagtcttgataactgtattttaatttaccaatcaataacaggtatttttgaaaaaaggattgatttgttaaaggtatga

SEQ ID NO: 79 - DNA, 3957 bp, Lactobacillus animalis KCTC 3501
atgggaagtaatatgctgaaaaaagattatagtattgggttggatattgggacaaactcagtgggacatgctgtagttactgatgattataaagttcctaccaaaaagatgaaagtttttggggatacatctaaaaaaacgatcaagaaaaacatgctgggagttttactgttcaatgaaggacagacggcagctgatacccgtttgaagcgcgggactcgccggcgctatacccggcgaaaaaatcgtttgcgctatttacaagagatctttgcaccagaattggctaaggtcgatcctaatttcttatatcgactagaagaaagttcactggtggctgaagataagaagtatgatgtgtatcctatctttggaaagcgtgaagaagaattactgtatcatgatacatataagacgatctatcacttacgcagtgcactagctaataatgatcaaccagctgatctaagattggtttatttggctttagcacatattatcaagtatcgggggaattttttactggaaggtgaaattgatctaagaactactgatatcaacaaagtatttgcggagttcagtgaaactctaaatgagaatagtgatgaaaatttgggtaaactagatgttgctgatatcttcaaaaataatacattctcaaaaacaaaaaaatctgaagaactgctgaaacttagtggggctaagaaaaatcaactagctcatcaattattcaagatgatggtcggcaatatgggtagcttcaagaaagtgctagggaccgatgaagaacacaaattatcctttggaaaggatacatacgaagatgatttgaatgacttattggctgaagctggtgatcaatatttagatatctttgttgctgctaagaaagtgtatgatgcagctattttggcaagtattttagatgtaaaagatacgcaaacaaagactgttttctcacaagcgatgatcgaacgctatgaagaacatcaaaaagacctaattgaattgaaacgagtctttaaaaaatatcttcctgagaaatgtcatgactttttcagtgaacctaagatcagtggttatgcgggatatattgatggcaaagtaagtgaagaagatttctataagtatactaagaagactttgaaggggatccctgagacagaagagatcttacaaaagatcgatgctaataattatttgcgaaaacaaagaacatttgataatggtgcgatcccgcatcaagtccatttaaaagaactagtggcaatagttgaaaatcaaggtaaatactatcctttcttacgtgaaaataaagataagtttgaaaagatcttaaacttccgaatcccgtattatgttgggcctttagcgcgcggaaacagtaaatttgcatggttgacccgagctggtgaaggaaaaataacaccatataactttgatgaaatgatcgacaaggagacttcagctgaagatttcattaaacacatgacgatcaacgatctatatctaccgactgagccagttttgcctaagcatagtttattatatgagagatacactatctttaatgagttagctggtgtcagatatgtgactgaaaatggtgaggctaagtattttgatgcccaaaccaagcgctcgatctttgaactttttaaattagaccgaaaagtaagtgaaaaaatggttattaagcatctgaaagttgttatgccagccatcaggatccaagctttgaaagggttggacaacggaaaattcaacgcttcttacggaacctataaagatttagttgatatgggtgttgcgccagaacttttaaatgatgaagtaaatagtgaaaagtgggaagatatcatcaagactctaactatctttgaaggacgcaaattgatcaaacgtcgcttagaaaactatcgtgactttttaggcgaagatatattacgtaaattgagtcggaaaaaatatacggggtgggggcgcctttcagctaagctgttggatggtatctatgacaaaaagacacataagacgatcttagattgtttgatgactgaagattacagtcaaaatttcatgcaattgatcaatgatgataactattcattcaaggaaacgatcaaaaatgcccaagtgatcgaaaaagaggaaactttggctaaaactgtacaggaattacctggaagtccagctattaagaaggggatcttacagagtttagagatcgttgatgagatcatcaaagtcatgggatataagcctaaaagtattgtagtcgaaatggcgcgtgaaacccagaaaacgcatgggacacggaaacgtgaagatcgagtgcaacagattgtggaaaacttaaaagatgctaatgaattacctgaaaaattgccaagtaatgctgaattgagtgatgaaagaaagtacttgtattgcttacaaaatggacgtgatatgtataccggggctcctctagactatgaccatttgcagttttatgatgttgaccatattattccgcagagctttttgaaagatgattcaatcgaaaataaggtcttaacgatcaaaaaagaaaatgtccgtaagactaatggtctgccaagtgaagccgtgatccaaaagatgggaagtttctggaaaaaattgttagatgctggagctatgaccaacaaaaaatatgacaatctacggcgtaatcttcatggcggattgaatgaaaaactaaaagaacgttttatcgaacgccaattggtcgaaacacggcagatcactaaatatgtggcacagctcttagaccaacgactaaattatgatggaaatggtgttgaacttgatgaaaaaattgcgatcgttactctaaaagctcagttagcttcgcaatttaggagcgaattcaaactgcgcaaagtaagagcgctcaataatttacatcatgctcacgatgcttatcttaatgctattgtagccaatttgatcatggcaaaatatcccgaattggagccagaatttgtctatggtaagtaccgcaaagctaagtttaaaggtttaggcaaagctacagctaaaaataccttatatgctaacgttttatatttcttaaaagagaatgaagtatatcctttctgggataaagcacgtgatctcccaacgatcaagcgttatttatatcgggcacaagttaataaagttcgcaaagctgaacgccaaatcggtggcttttctgatgaaatgttggtacctaagagtgattcaggtaagctactgccacgaaaagaagggctcgatccagttaaatatggtggctatgccaaagcggtagaaagttatgcggttttgatcactgcagatgaagtcaaaaaaggcaaaacaaagaaagtgaaaactttagtaaatattccgatcatagatagtaagaaatatgaggctgatccaactgcatatttagctagtcgtgggtatacaaacgtcacaaatagttttattttgcctaagtatagtctgcttgaagatccagaaggtcgtcgtcgttatctagcaagtttcaaggaatttcaaaaagcaaatgaattgatcttgccacagcatctagtagagttgctctattgggtcaatgcaaaagatggagagcaaaaattagaggatcataaagctgaatttaaagaattatttgataagatcatggagtttgcggataagtatgttgttgcacctaaaaattcagaaaagatcagacgcttatacgaagaaaatcaagatgctaccccaatggaattgggtaagaactttgttgagctcttgagatatacagctgatggtgctgcgagcgatttcaaattctttggcgaaaatattccacggaaacgatataattcggcaggaagtttgctcaatggaacattgatctatcagtcaaaaacggggttatatgaaacaaggatcgatctaggtaaattataa

SEQ ID NO: 80 - DNA, 4188 bp, Lactobacillus ceti DSM 22408
atgagtaaaaaatatcaaaacacaaagtattatgtagggcttgatatcggaacgtcgtctgttgggtgggctgtaacagacgcgaattatgagttattaaaagttaatggtcataagacatggggatcaagattattcacagaggctgaaacggcacttgaacggcgaacacaccgcgctactcggagaagactgcaaagaagaaaacaaagactggatttattagatgaattatttgctgaagaacttgctaaagtagatccacagtttttacttcgtttgaaggaaagtcagtatcatatggaagataaaagtacagatgataagtatgttttgtttaatgatcaaaatagaacagatggagaattttttacagagtatccaacgatttatcatttgcgtagtgaattaatgcaagggaaaaaagaggatatacgtgcagtatatcttgcattacatcatatcgtgaaatatcgtggccacttcttattacctggagataattatgatatgcaaggtaatttaagtgaactgattaagaggctgtttaaatttattgaagaaactttatttattgaagatcttggattgacggatgaaattcaatccaaaatagaagaaattttattgacaaagacaaaaactcgtcttgatcgccaaaaagaaattgtcaaactttttaatacaaaacatcaaaaattagatgataaacaaaaaaaattattagaagctatttttaaattatgtttaggtcttaaaggtaatatggttaatatttttggtgacaaaggtgaatatggaattgattttactgatgtcgaagataagaagaaaaaggtagaatttagtgctgattatgataataacattaatgactatgtagatttctttggtgaatattttgaattgttagaaattacgaaaaaaattaatgatacagttattttttctgaaattttagtcgatggaaaaggtttttctgaatctaaagtaatttcttatgaaaaacatcaacaagatttgcgcaaattaaagacactcttgaagagtctagataaaaccttggggtataaatacggagaaggattataccaaaaaatattacttgatgatgtaaaatctaattatgttaattattcaggaaattctcaaaaattaaaaaaatgtactaaagatgagttttatgggtttatcaagagtaagttaaattcagttaccaagaaagaaaaggtttctgaagctcaacaaaaagaaatcgctcagattctcgctgatatggaatttggtgattatctaccgctgcaacgtacaactgataatggtgttattccaaaccaattacacaaaaaggaattaattgaaattattgaacaacaaactaagtatcatgattttttcaatgatgtagatgaaaatgggctaactattaaagataagattatttcattaatgacttttagaataccttattatgtcggaccattgaatgattatcataaagttgctgatggaacaggacatgcttggattgaaaagaaaaaagacggtaaaatctatccttggaattttgatgagatggttgatacagaggctactgcagaaaaattcattaaaaatttgacgaataaatgcacctatttaaaaggtgaagatgtattgccaaaagaatcgaagctgtattctgaatttatgttattaaatgaacttaataatattaaaatagataatcaaaaattggatcctaaattgaagatgaaaatggtatcagagttgtttatgaaaaaaaacgaaaagataacgaagaaaaaaattgttgattacttacgctcaattggtcaagctaatggtaacgagatggttagtggaattgatcgggaaatcaaatctgatctgaaaactattcataaaattcaacattattaccaagacgcatcgctagaaatggcggaaaatattattcgttggaataccatttttaatgattctacttctgacatattaaaggataaaatcacaaaagcatatggtgatgtattaactcctggtcagattaaaggattgtctaatctagcatgtaaagattgggggaaattatctgaaaaattcttaacaggtattcgttgtgatgtgggagaatttaaaaatattagtattattcaagctatgcgagatactaataataacttgatggaattattatcgaataaatatgaatttatggataagattcaagaatacaataaagaatattatggtgattttaccttcaaagcagaaccctctattatggatgatttatatgtgggacccggtccgaaaagagctatttggcaagcggtacggattgttgaagaaattaagcggattatggggcatgatccagaaaaaatctttcttgaaacaacaagaactaatcgggcaccaaaggttaagaacactaaacgttatgatgcgttagaaaaaaagtatgagtccgttaaagagcacgaatatgcagaagtaaagaaagaatttgaaattgaaaaaaatgatagtttaaatataaagaagttatttctttattttacacaactcggacactgcatgtattctgacgaaaaaattccttataatgaattattcactaatcgttatgatattgatcatatttatccacgaagtaaaacaagagataactctatggacaatctcgtattggtgaaagcagaatgtaatagagataagaaagataattatccaattaagcttaaaacaaatattcaacagaaatgtcaggttcgttgggcatatttacgtgataaaaaacttattactgaagaaaaatataatcgcttagtgcgtaaaacaccattaactgaagatgaattgtcacaatttattgccagacaattagtgtttacatcacaatctgtcaaagcaacagcggaagtatttaaaaggttatatgaagattctaaaatttgttatgttaaagctgagaatgttagtgactttagatatggttcaactagaaaaatgagtaaagatgatcaaccgcaaccttttatcaaaaatcgcgatgtgaatgattttcatcatgcgaaagatgcttatttaaatattgtagtgggtaatgtatatgatgttaaattcacacaaaatccaacgagatttattaaagcaaataaagattatagtttgaattatatttttagatatcctgtgaataaaaaaggtgagaatgtttgggatccagaacaatcgatgaagatagtggaaaaaacattgaaaagcaatgatgtgcgtgtcactaaattagtgaagccaatcactagtccaatatccaacgaaactcttcataaagcattaaaatgtaaacctggttcttatttaccacgtaaatcttctaaaggaacacccttggcagatgtgactaaatatggtggatatgaaaagattaaaaatgcatattacagtatttataaatatacctatatgaagaaaaaagaatgtatggaagagtttctacttgtacctataccaattcatttggtgaataacgatgaagaattaccaaaatatataaacgataagatagccgaaagagcaaaaaagaaaaaattggaaacagtcgagtgtattgtaaaagaattatatcaaggaactttagttagaataaatgggtatgattatcgtattgcaggaagttcgggaaaacaattcgaattgcataatgggattaatctgattgttgaaccttgggttgaaaaagttctgaaagaaacagataaattcgtgcgaaaatctaattcaaaattagataaaaaacaacaaaaagagaatacaactgaaactctgattgaaaaacaattaaatgatgtatttgaatatctctgtcggaaattaaatcaaggcatattcaaaaacaacaaacatacattacctgctaaactgttgggggatagtattcaaaaacgttttgaagatgctagtattgaagatgaatttgaggttataaaagaattgataagtgctatagcgaagaatcctcagaatttcaaaacgattcaaaaagtactagatatatccggcagttcgataccaagatttaatttaaagcttacaaaaaataatgtagacgagtttattattaaaaatgaatcggtgactggtttatttacacatgagaaagttatttttagaaaatag

SEQ ID NO: 81 - DNA, 4203 bp, Tissierellia bacterium KA00581
atgggaaaacaaaaatttaatgattactatttaggatttgacatcggaactaactctgcgggctgggctgttacagacttacagtataaacttttaagattcaataaaaaagatatgtggggaagtaggctgtttgatgaagcacagacttctaaagaaagaagagtttacagaaatagtagaagaaggcttgatagaagaaaaaaacgtttaaaacttttagaagaactatttttagatgaaatttcaaaaattgataatactttttttaaaagacttaaagaaagtaatttgtataatgaagataaatcgattaagtttaattatcctttatttaacgacaaagactatacggatattgacttttacaatgaatataaaactatatatcatttgagaaaagatttaatttttgaggataaaaaatttgatataagacttgtatttatagctttgcatcatattttaaaatatagaggtcattttatctttgaaggacaaagttttgaagaaataaaaagttttgattctatttttacacaattatcatcttattttttagaaaattttgattttaatatagatgtaagtataaaagaaaaattagaagaaattattttaagcgataatactaaatcaataaagaaaacagaatttaaaaagatattttcagataacaaagtattgtctgttttaaatatggcaataggaagtaaagtttctcttaaagatgtttttaacaatgaagagcttaaagagcaaaaaattagtttttctgaaattgattatgaaaacgaaaaaagagatgaattttatcagcttttaggagaagatatttttttaatagatttagcaaagaaaatttatgattttatggttttaaagaaaatactaaaaaatactgatagtttttctgcatctaaagtagctttatattgtgaacataaaaaagatttagacgatttaaaatatattttcaaaaaatatttaacaaaagaagattattttaaattttttagaagtaatgtagaaaaaattaattatccaagttatattgggttaaataaaataaagtcaaaaaaaataattaaagaaaataaatgtagtatatctgatataaataaggaattaaaaaacaaatatcttaaagatataaaattagaagctaaagataaagagttatttaatcgtatttttaataaacttgatgaatttaaatttttagaaaaattaaaaagtagtgaaaattcaaccgttccttatcaagttcatgaaatagaattaaagaaaatacttgataatcaaagaaaatactatccgtttttaaatgaaaaaatcgacggaaaaagtgtttatgaaaaaatcatacaactttttgaatttaaaattccatactatataggacctcttaatacagatcctaatgtaaaaggcaaaaatacttgggttgttagaaaagatgaaaataataaaactccaataactccttggaattttgaacaaaaagttgacatgcaaaaaagtgctgaggaattcattaagagaatgacaaacagatgtacttacttaaaagcagaagatgttatagcaaaaaactcactattatatgaagaatttattcttcttaatgagttaaataaagttacagttgataatgaaattttacatcctactttaaaaactgaaataataaatgaattgtttaaaacaacagttaaagttacaaagaaaaaatttattgagtttttgaaaaaaaagcaagctgtaaatgatgttgagagcattactggaataggtgttgagtttaattgtaagctacaaggatataacacatttagaaaaattttaggtaaaaagatagaaaacgtaaatgtaaaaaattttgtagaaaagtgtatagagcttaaatgcttatatggaagtgataaaaaattatttgaaaatgcaattggaaaaatatatagagaatataatataacagatgaagaatttaataaaattaatagattaaattttaacaaatgggcaaggctttctaaaaaatttctaacagaaataagttttgaaaaaactgatggtacaaaaagatttgaaagtgttatagaagcgttaagaagtactaactataatttaatggaacttttatctgataaatttaatttgcaatctaaaatagatgaaattaatggagaagatgatttttctaatatagatataaaagaatatgtagataaattatatgtttctccatctgttaagcgttctattattcaaacttataaaattgctatggaaataaagaaaattacaaagaaagatcctaaaaaaatattcattgaaatggcaaaagataaaggagaaaaaggcaaaactacagaaaaaagaaaagataaaataaaaaaattatataaaaatatcaaagataccctttctgattattgcaataatttacaagatttaactttgcaagttgaaaagtatgatgataatagattaagacaaaagaagttatttttgtattttatgcaaatgggaaaatccatgtatacaggaagatgtatagatttagaagatttatttaataataatgtttatgatattgaccatatatatcctcaatcaaaagtaaaagatgatagttttgataatattgtactagttgaaaaagaagaaaatcatagaaagtcaaatgaacttcttaaagaagaaattcaatctagaatgaataattactggatatttttaagagaaaataaattcatttcaaaagaaaagtataatagacttacaagaaaaaaagattttacagatgaagaacttggcgattttgttgcaagacagcttgttacaacaagacaatctacaaaagagattgcaaaattttttgaaaaaatatttgaaaaaacaactgttgtatattcaaaagcttccttagtaagtgagtttagagaaaagtatgatatcataaaggtaagagaagtaaatgacgctcaccacgcacaagatgcctacttaaatatagtcgtaggaaatgtctttaatactaaatttactaaaaattattggaaatttacaaaagatataaaaagacaaaacgaagaaaatcctaatgaaaaaaaaggatacaacttaagaaagatttatgaatctgatgttttttgtaacgatagtgttgcttgggtatattcaaaagaaaatccgaaatacaatacaataaataccgtaaaagatatggtatacagaaaaactgcaaatataacaagaatgcttgtagagggaaaaggacaactatttaatttaacaataaaagataaaacacaattaaagaaaaatgttggaaatatagttgcaaacactcctatatctttaaaaaataggaaattacatttaaatagcgttgaaattgctaaaaaatatggttattttgattctttaaataatgcttattttgttttgtttaagtatgaagaaaaaggaaaagaaaagattggatttgactcaataactattgcctataaagaaaggttaaaaaagaatttagatatagaaaagtttttagaaaataaaggatataaaaattctaaattgataagaaagatatttaaaaatcaaaaagttttaataaacggatatccttatttattaaaatcatttaacaaacaaagtcaaattaaatttaataatttcaaaatattatatcttaatgaaaataatttaaaatttgcaaaagatgcaataaaatttgaaaaaaataatgctaatgttgatttgaaaaagcaaaaatatatagtaagttttctaaaaaagaaaaagcaaaacgaaattaatgaaacttatgaagaatgtattgatagattaaatgatgaatttgatacactatttttaaaactttgcgatattcaaaaatcatcaatatatacaaattacaaattacaagattttagttcaaataaaaaatcaattgaaattaaagataaatttgatatttttaaaagtttagatttatataaaaaatctaaattaataaaagaatttttaaactattataaatatgagaaaaacgacttagattttagtcttatagatattgataaaaaagcaaattgtattcaaaaacattttacagaagatctggttaaagattttgttattgttgatgagtctgttacaggattgtttgtgaaaaaagaaaggcttaaataa

SEQ ID NO: 82 - DNA, 4197 bp, Veillonella parvula ATCC 17745
atggaaacgcaagcatcgaaccaacttatttcaagtcatttgaaaggatatccaattaaagattattttgtggggttagatattggtacaagctcagtgggctgggcagtaaccaataaggcctatgagttgctgaaatttcgatctcataaaatgtggggaagtcgtttgtttgatgagggagaatccgctgtagcacgtcgtggattccggtccatgcgtcgtcgtttggaacgtcgtaaattacgcttaaaactattagaagaattgtttgctgatgctatggcacaggtggatcctacattctttatgcgccttcgtgaaagtaagtaccactatgaggataaaacgaccggtcatagttcaaaacatattttgtttatcgataaaaactataatgatcaagattattttaaagagtatcctactgtttatcatttgcgttcagaattgatgaaatctggtactgatgatattcgcaaactatttttagctgtacatcatattttaaaatatcgtggtaacttcctttatgaaggggctacatttgactctaatgcttcaacgcttgatgatgttattaaacaagctttagaaaatattacatttaattgctttgattgtaattctgctattagctctatagggcaaatccttatggaggctggaaaaacaaaatctgataaagccaaagccatagaacatttggttgatacatatatagctactgatacagtagatacttctagtaaaactcaaaaagatcaagtcaaagaagataaaaaaagacttaaagcatttgcaaatttagtattaggtttaaatgctagtcttatagacttgttcggctctgtagaagagttagaagaagatcttaaaaagcttcaaataacaggagacacatatgacgataaacgagatgagctagctaaagcttggagtgatgagatttatattattgatgattgtaaatctgtatatgatgctattatactcctgtccattaaagaacctggtcttactatttctgaatctaaggtaaaagctttcaacaagcataaagatgatttagctatattgaaatctttactaaagtcggatagaagcatttacaatacaatgttcaaagttgatgaaaaaggtctacacaactatgtgcattatattaaacaaggtcgtactgaggaaactagttgtaaccgtgaagatttttataaatacactaagaaaatagtagaaggactatctgattctaaggataaagaatatattcttagtcaaattgagctacaaatattattaccattacaacgaattaaagacaatggtgttattccttatcaattacatttagaagaactcaaagcgatccttgctaaatgtggtcctaaattcccatttttaaatgaagtggcggatggtttttctgtagcagagaaacttattaaaatgcttgagtttcgcattccgtattacgtagggcctttaaatactcatcataatgtagataacggtggttttgcttgggcggttcggaaagcatctggacgagtaactccgtggaattttgatgataaaattgatcgggaaaaatcagcagcagcttttatcaaaaaccttactaataaatgcacttaccttttgggcgaggatgtgctgcccaaatcatcacttttgtatagtgagtttatgttgcttaacgaactaaataatgtacgtattgatggtaaaccattagagaaagtggtaaaagaacatcttattgaggctgtatttaagcaagaccataaaaagatgactaaaaatcggatagagcagtttttaaaagataatggttatatttcagaaactcataaacatgagattacaggtctagatggggaaattaaaaatgatttagcctcttatcgtgatatggttcgtatccttggcgatggttttgatagatctatggctgaagagattattacggatattactatctttggtgaaagtaaaaaaatgttgcgagaaacattgcgtaaaaaattcgcttcgtgccttgatgatgaagctatcaagaagctgacaaaattaagatatcgagattggggccgtctctcccaaaaattactgaatggtatcgagggatgtgataaagctggtgatggtacgcctgaaactattattatattgatgcgtaatttcagctataacttgatggaattattaggcgataaattctcttttatggaacgtattcaagaaataaatgctaaattaacagaaggtcaaatcgtgaaccctcatgatattatcgatgatttagcgctttcaccagctgttaagcgtgcggtatggcaagcattgcgcatcgttgatgaggttgcacatattaaaaaagcgttaccggctcgtatctttgtagaagtaacacggtcaaataaaaacgagaaaaagaaaaaagactctcgtcaaaaacgattatctgatttatatgcagcgattaaaaaggatgatgtgttattaaatggccttaataatgaaatctttggggaactgaaatcaagtttggctaaatatgatgatgcggctttaagaagtaaaaagttgtatctatattatactcaaatggggcgctgtgcttataccggtgagattatagagctaagtctgttaaatacagataattatgatatcgaccatatttatcctcgtagccttaccaaggatgatagttttgataacttagtgttatgtaaacgaactgcaaatgctcagaaatcagatgcatatccaattagtgaagaaattcaaaagacacaaaagccattctggacattcttaaaacaacaaggtcttattagtgaacggaaatatgagcgtcttactcgcattacaccacttacagctgatgatttaagtggctttattgctcgtcaactagtagaaactaatcaatctgttaaggctgccacaacattactgcgtcgtctttacccaggtgttgatgtagtctttgtaaaggctgaaaatgtaacagacttccgtcatgataataactttatcaaagttcgctcattgaatcatcaccatcatgctaaagatgcttatttaaatattgttgttggtaatgtatatcatgaaagatttactcgtaacttccgtgcattctttaaaaagaatggagctaatcgtacatataatttagcgaagatgttcaattatgatgtaaattgcacaaatgctaaagatggaaaagcttgggatgtaaaaacaagcatggatactgttaagaaaatgatggacagcaacgatgttcgagtgacgaaacgtttattagaacaaactggtgcattagctgatgcaactatatataaagctactgttgcagggaaagctaaagatggtgcttatatagggatgaaaaccaagtctagtgtgtttgcagatgtttctaagtatggtggcatgacaaaaattaagaatgcctattctattattgttcaatatacaggtaaaaaaggcgaagtgattaaggaaatcgtgccattgccaatctatttaacaaatcgaaatacaactgatcaagatttaattaattatgtagcatctattattccacaagcaaaagacatttctatcatttatggaaaactgtgcattaatcaattagttaaggttaatggattctattattatttgggtgggaaaactaatagtaaattctgtattgataatgcgattcaagttattgtttcaaatgaatggattccatacctcaaagtgcttgagaagtttaataatatgagaaaagataataaggatttgaaggcaaatgttgtatcaacaagagctcttgataataagcatacgatagaggttagaatcgtagaagagaaaaatatagagttctttgattacttggtaagtaaacttaaaatgcctatatatcaaaaaatgaaagggaataaagcagctgaattatcagaaaagggatatggtttatttaaaaaaatgtctttagaagaacagagtattcatttgatagagcttttaaacttattaacaaatcaaaaaactacttttgaagttaagcctttaggaataacagcatctagatcaactgtggggagtaaaataagtaatcaagatgaatttaaagttatcaatgaatccattacaggattatattctaatgaagtaactatagtttaa

SEQ ID NO: 83 - DNA, 3393 bp, Streptococcus gallolyticus
atgacaaatggaaaaattttaggtttggatattggtattgcatctgtcggtgttggtattattgaagcgaaaactggtaaagtagtccatgctaattcacgtcttttttctgctgcaaatgcagaaaataatgcagagcgaagaggattccgtggctcaagacgcttaaatcgtcgtaaaaaacaccgtgttaaacgagttcgtgatttatttgagaaatatgagattgttactgattttagaaatttgaacttaaatccttatgaacttcgtgtaaaaggattaacagaacaacttacaaatgaagagctatttgctgctttacgaacaatctcaaaaagacgagggatttcatacttagatgatgcagaagacgattcaactggtagtactgactatgcaaaatctattgatgaaaaccgtcgcttgctaaaaaccaaaactcctggtcaaattcaattggaacgtttggaaaaatatggtcagttacgaggcaattttactgtttatgatgaaaatggtgaggctcatcgattaatcaatgttttttcaacttctgattatgaaaaagaggcacgtaaaattttagaaactcaagcggattacaataaaaaaattactgctgagtttattgatgattatgttgaaatcttgactcaaaaaagaaaatattaccatggaccaggtaatgaaaaatctcgtacagattatggacgttttcgcacagatggcacaacgctcgaaaatatttttggcattttaattggtaaatgtagtttttatcctgatgagtaccgtgcctcaaaagcttcttatactgcacaagaatataactttttaaatgatttaaacaatttaaaagttccaacagaaactggtaaattatctacggaacaaaaggaagctttagttgaatttgctaaaagtactgcaacgttaggtcctgctaaattattaaaagaaattgctaaaatactagattgtaaagttgatgaaattaaaggatatcgtgaagatgataaaggcaaaccagacttacatacatttgagccttatcgaaaattaaaattcaacttagattcagttaacattgatgatttatcaagagaagtccttgacaaattagctgatattttaacgcttaatacagaacgtgaaggtatcgaagacgctatcaggcataatttgccaaatcagtttactgagggacaaatctccgaaatcattaaggttagaaaaagtcaaagcacagctttcaataaaggttggcatagtttttcagctaaactaatgaatgaattaattcctgaattgtatgcgacatctgatgaacagatgacaattctaacaagattagagaaattcaaagttaataaaaaatcatcaaaaaatacaaaaactattgatgaaaaagaagtcacagacgaaatttataatccagttgtagctaaatctgttcgacaaacaataaaaatcattaacgcagcagttaaaaaatatggtgattttgataagattgttattgaaatgccacgtgataagaatgctgatgatgagaagaaatttattgataaaaggaataaggaaaataagaaagaaaaagatgacgctttaaaacgcgcagcttatctttataatggtactgataaattacctgatgaggtctttcatggaaataaacagttagaaacaaaaattcgactttggtatcaacaaggtgaacgttgtttgtattctggcaaaccaattccaattcaagagttagtacataattcaaataactttgaaattgatcatattttacctctgtcgctttcttttgatgatagtttagcaaataaagtattagtttatgcttggacaaatcaagaaaaaggacaaaaaactccttatcaagtaattgattctatggatgcagcatggtcatttagagaaatgaaagactatgtcttaaagcaaaaaggactcggtaagaaaaaacgtgactatcttttaacaacagaaaatatcgataaaatcgaagttaaaaagaaatttattgagcgtaatttggtagatacacgatacgcatcgcgtgttgtccttaatagtctccaatctgcattaagagaattgggtaaagatactaaaatttctgttatcagaggtcagtttacatcacaactacgtcgaaaatggaagattgataaatcgcgtgaaacgtaccatcaccatgctgttgatgctttgattatcgctgcttcaagtcaattaaaactgtgggaaaaacaagataatccaatgtttgtggattatggaaataatcaagttgttgataaacaaacaggggaaattttgtctgtttctgatgatgaatacaaagaattggtattccagccaccgtatcaaggttttgttaacatgatttcaagtaaagggtttgaggacgaaattttgttctcttatcaagttgattcaaaatataatcgtaaggtatctgatgcaactatctactcaacgcgaaaagctaaaattggaaaagataaaaaagaagagacttatgttttagggaaaattaaagacatttacagtcaaaatggatttgatacctttattaagaaatataacaaagataagacacaatttttaatgtatcaaaaagatcctctaacttgggaaaatgtcattgaggtgattctaagagattatccaactacaaaaaaatctgaagatggaaaaaatgatgtcaaatgtaatccatttgaagaatatcgtagagaaaacggcttagtctgcaaatacagcaaaaaaggaaaaggcacaccgattaaatctcttaaatactatgataaaaaattgggaaattgcattgatataacgcctgaaggaagcaaaaatgaagttgtactgcaatctttaaatccttggcgtgctgatgtttactttaatcctgagactttaaaatatgaactgttgggattgaaatattctgatttaagttttgaaaaaggtactggtaagtatcatatttcacaagaaaaatatgatgtgataaaggaaaaagaaggcattggtaaaaaatctgaatttaagtttactctttaccgaaatgatttgattttgatcaaagatacagctagtggtgagcaagagatttatcgattcttatctagaaccatgccgaatgtcaaacattatgcggaattgaaaccatacgataaagagaaatttgataatgttcaagaattagttgaggctttgggagaagcagataaagttggacgttgtataaaaggtttgaataaatccaacctctcaatctataaagttcgcacagatgttcttggaaacaagtattttgttaaaaaagagggcgataaacctaagttggattttaaaaataataaaaaataa

SEQ ID NO: 84 - DNA, 3165 bp, Staphylococcus pasteuri
atgaaagaaaaatatattttgggtttagatttaggtattacatcagtaggatatggaattattaattttgaaactaaaaaaattatagatgcaggagttaggctttttccagaagcaaacgtagataataatgaaggtcgtagaagtaaaagaggatctagacgattaaaaagacgaagaatacatagattagaacgagtaaaattattactcacagaatatgacctaataaataaagaacaaataccaacatcaaataatccttatcaaattagagttaaaggactaagtgaaatattaagtaaagatgaacttgctattgctttattacatttagcgaaaagaaggggaattcacaacattaatgttagtagtgaagatgaggatgcctccaatgagttatctacaaaggaacagattaatagaaataataaactattaaaagataaatatgtttgtgaagtacagttacaaagattaaaagaaggacaaataaggggagaaaaaaacaggttcaaaacaacagatatattaaaggaaattgatcaactccttaaagtgcaaaaagattatcacaacttagatatagatttcattaaccaatataaagaaatagttgaaacacgtcgagagtattttgaaggaccaggacaaggtagtccttttggatggaatggtgatttgaagaaatggtatgaaatgttaatgggacactgcacatatttcccccaagaattacgaagtgtaaaatatgcatattctgctgatttatttaacgcattaaatgatttaaataatctcataatacaaagagataattctgaaaaattagaatatcatgaaaaatatcatattattgaaaatgtatttaaacaaaagaaaaagccaactttaaaacaaattgctaaagaaataggggtaaatccagaagatattaaaggttatagaataacaaaatctgggacaccgcaatttacagaatttaaattatatcatgatctaaagtcaattgtgtttgataaaagtattttagaaaatgaagctattttagaccaaattgctgaaatattaacaatctatcaagatgagcagagcataaaagaagagctaaacaaattaccagaaatcttaaatgaacaagataaagctgaaatagctaaactaataggatataacggaacacatcgcttgtcattaaaatgtattcatttaattaatgaagaattatggcaaacatctagaaaccagatggaaatctttaattatttgaacattaaaccgaacaaagtcgacttatccgaacaaaataaaataccaaaagatatggtgaacgactttattttatctcctgtagtgaaaaggacttttattcaatcaataaatgttatcaataaagtgattgaaaaatacggtatacctgaagatatcattatagaattagctcgagaaaataatagtgatgatagaaaaaaatttattaataacctacaaaagaaaaacgaagcaactcgtaagagaataaatgaaataattggccaaactggaaatcaaaatgccaaaagaattgtagagaagataagattacatgatcaacaagaaggtaaatgtttgtattcattagaaagtatagctttaatggatttgttaaataatcctcaaaattatgaagtcgatcatattattcctcgttctgtagcatttgataactcaattcataataaagtgttagttaaacaaatagaaaatagtaaaaaaggtaatagaacaccataccaataccttaattctagtgatgcaaagttatcatacaatcaatttaagcaacatatcttaaatttaagtaagtcgaaagatagaatttctaagaaaaagaaagactatttattggaagaacgggatattaataaattcgaagtacaaaaggaatttatcaatcgaaatttagtagatacaagatatgcgactagagaacttactagctatctaaaagcatattttagtgctaataacatggatgtaaaagttaaaacaattaatgggagttttaccaatcatttaagaaaagtatggagatttgataaatatagaaatcatggttacaaacatcatgctgaagacgctttaataatcgcaaatgcagattttttatttaaagaaaataaaaaattacaaaatacaaataaaattttagaaaaaccaacaattgaaaataatactaaaaaagtaacagttgaaaaagaagaagattataacaacgtgtttgagacacctaagcttgttgaagacattaaacaatacagagattataaattttctcatagagtagataagaaaccgaatagacaacttattaatgacactttatattctacaagaatgaaagacgaacatgattacattgttcaaactattacggatatttatgggaaagataatactaatttaaaaaagcagtttaataaaaatccagaaaaatttttaatgtaccaaaatgatccaaaaacttttgaaaaattatcaattataatgaaacagtattctgatgaaaaaaacccgctagctaagtattatgaagagaccggagaatatttaacaaagtatagtaaaaaaaataatggtccaattgttaaaaagataaagcttttaggaaataaagtagggaatcatttagatgtaacaaataaatacgaaaattctacaaaaaaattagtgaaattatcaattaaaaattataggtttgatgtttatttaactgaaaaaggatataaattcgtaacaattgcttatttaaatgtatttaagaaagataattattattatatccctaaagataagtatcaagaattaaaagaaaagaaaaaaattaaagatacagatcaatttattgccagtttttataagaatgatttgattaaactaaatggcgatttgtacaaaattattggtgtgaatagtgatgacagaaatatcattgaattagattattacgatattaaatataaagattactgtgagataaataatattaaaggtgaaccacgtataaagaaaacaattggtaaaaagacggaatcaattgaaaaatttacaacagatgttttaggtaatttgtatttgcatagtactgaaaaagcaccacaattaatatttaaacgaggtctttaa

SEQ ID NO: 85 - DNA, 4014 bp, Enterococcus faecalis OG1RF
atgaagaaagactacgttattggtctggatatagggactaattctgtcggctgggcagttatgacagaagactatcagttggtgaagaaaaaaatgcctatttatggaaacactgaaaaaaagaaaatcaagaaaaatttttggggtgtgcgtttatttgaagaagggcatacagccgaagatcgccgattaaaaagaacagcacgacgaagaattagtcgtcgacggaatcgtttacgctacttacaagctttttttgaagaagcgatgacagatttggatgaaaacttttttgctcgtttacaagagagttttttagtgcctgaagataagaagtggcacagacatccgatttttgctaagttggaagatgaagtagcttaccatgaaacgtatccgacaatctaccatttacgcaaaaaattagcagattcatctgagcaagcagatttacgactaatttatttggcgttggcacatattgtcaaatatcgtggacattttttaattgaaggaaaattaagtacagaaaatatttctgttaaagaacaatttcaacaatttatgatcatttataaccaaacctttgtgaatggagagagtcgcttagttagtgcgccattacctgaatctgtcttgattgaggaagagttgactgaaaaagcttctcggactaaaaaatctgaaaaagtcttacaacaatttcctcaagaaaaagctaatggcttatttggtcagttcttaaagctaatggtagggaataaagctgactttaaaaaagtttttggtttggaagaagaagccaaaataacctacgctagtgaaagctatgaagaagatttagaaggcattttagcaaaggttggggatgaatatagtgacgtgtttttagctgctaaaaatgtgtacgatgcagttgaattatcaacgattttagcagattcggataaaaaaagtcacgcgaaattatcttctagcatgattgtccgttttacagaacaccaagaagatttaaaaaaattcaaacgatttattcgtgaaaattgtccagacgaatatgataatctctttaaaaatgaacagaaagacggctatgcaggctacattgcacacgcaggtaaggtttcacagcttaaattttaccagtatgttaagaaaatcattcaagatattgctggagcagaatattttttagaaaaaattgctcaagaaaactttttaagaaagcaacggacctttgataatggggtgattcctcatcaaattcatttggctgagttacaagcaatcattcatcgtcaagcggcctattatccatttttaaaagaaaatcaagaaaaaattgaacaactggttacatttcgaattccttattatgtcggaccattatcaaaaggagatgcaagtaccttcgcttggttaaaacgtcaaagtgaggaaccaattcgtccttggaaccttcaagaaaccgttgatttggaccaatcagcgacagcctttattgaacgaatgaccaattttgatacgtatttaccttctgaaaaagttttaccgaaacatagtttgttatatgaaaagtttatggtatttaatgaattgaccaagatttcttatacggatgatcgaggcatcaaagccaatttttcaggtaaggaaaaagaaaaaatctttgattatctgtttaagacgcgtcgaaaagttaagaaaaaggatatcattcaattctatcgaaacgaatataatacggagattgtcacgcttagtggacttgaagaagaccaatttaatgctagttttagcacgtatcaggatttactgaaatgtggtttgacacgagcagaattagaccacccagataatgccgaaaaattggaagatatcataaaaattttaactatttttgaagatcggcaacgaattcggacgcaactttctacattcaaagggcagttctcagcagaagtactaaaaaaattagaacgcaagcactacactggctggggaagattgtcgaagaaattaatcaatggtatctacgataaagaatcgggtaaaacaattttggactatttagttaaagatgatggggtctcaaaacactataatcgcaattttatgcaactgattaatgattcacaattatcttttaaaaatgctattcaaaaagcacagtccagtgaacatgaagaaacattaagtgaaactgtcaatgaattagctggtagcccagcaataaaaaaaggaatttatcaaagtttaaaaattgtcgatgaactagtcgcgattatgggttatgcgcctaagcggattgttgtcgaaatggcacgtgaaaatcaaacgactagcactggcaagagaagatccatccaacgcttgaaaatagttgaaaaagcaatggccgaaatcggcagcaatttattaaaagaacaaccaacgactaatgaacagttacgagatacccgtcttttcctttactatatgcaaaatggtaaagatatgtacacgggagatgaattatcgcttcatcgtttatctcactatgatattgatcatattatcccacaaagttttatgaaagacgattcattggataacctagttttagtgggctctactgaaaatcgagggaaatccgatgatgtacctagcaaggaagttgttaaggatatgaaagcttattgggagaaattatatgctgctggcttaattagtcaacggaaattccaacgtctgaccaagggggagcaaggtggcttgactctcgaagacaaagcgcattttatccaacggcaattagtagaaactcgtcaaattactaaaaatgttgcgggaatcctaaatcaacgctacaatgctaattcaaaagagaaaaaagtccaaatcatcaccttgaaagctagtttaacaagccaatttcgttcgatttttggcttgtataaagtccgtgaagtgaatgattatcaccatggacaagatgcttatttaaactgtgtggtcgcaaccacgttattaaaagtttatcctaatttagcaccagaatttgtttacggagaatatcctaagttccagacctttaaagaaaataaagccacggcgaaggctataatttatacaaatttgctgcgctttttcacggaagatgaaccacggttcacgaaggatggcgaaattctttggagtaacagttatttgaaaactatcaaaaaagaattaaattaccatcaaatgaatattgtcaaaaaagtagaagtgcaaaaaggcggtttttcaaaagagtcgattaaacccaaaggaccatcgaataaattgattcctgtcaaaaatggtttggatccccaaaaatatggcggttttgatagtcctgtggttgcttatacagtgttattcacgcatgaaaaaggtaaaaaacctcttattaaacaggagatactgggcattacgattatggaaaaaacaaggtttgaacaaaatcctattctttttttagaggagaaaggcttcctgcggcctcgtgtattaatgaaattgcctaagtatacactgtatgaatttccagaggggcgccggcgcttattagctagcgctaaagaagcgcaaaaagggaaccagatggttttacctgaacatttacttacattactgtaccatgcgaaacaatgtttgttaccaaatcaatcagaaagtttggcttatgtagaacaacatcaaccagaatttcaagagattttagagagagtggttgactttgctgaagtgcatacattagccaagtcaaaagtccagcaaattgtgaaactttttgaagcaaatcaaacagcagatgtgaaagagattgcggcatcctttatccaacttatgcagtttaatgcgatgggcgcaccaagtacgtttaaatttttccaaaaagatattgagcgagcacgctacacgtcaatcaaagaaatttttgatgccactatcatttaccaatcgactacgggactgtatgaaacacgcagaaaggttgtcgactag

SEQ ID NO: 86 - protein, 1380 aa, Prevotella histicola
MKKILGLDLGTTSIGWALVYESENADEKSSIVRLGVRVNPLSVDEKGNFEKGKSITTNADRQQTHGARINLQRYKLRRENLKDCLQKQGWIGTEALYEEGKTSTFETYMLRAKAAEEEISLHELCRVLFMLNKKRGYKSNRKANNKEDGKLFDGMTVAKKLYEEHLTPAEYSLKLLSSGKKFKQEYYRSDLKEEFDRIWNEQQKYYPEILTDDFKQQLQGKSKGNTSKIFLGKYGIYSADLKGLDRKLQPLKWRVEALKQKVDKEVLAFVISDLNGQIASTSGLLGAISDRSKELYFNKQTVGQYLWTSLKESPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSNRPLYEEERNLLYEELSVKEKLSKAEALKVLNKNGKQWDLNYKEIEGNRTQAVLYDCYNRIIGMTGHEECNFKKLKASDIRYNVKTIFKNLGFSTDILDFDSSLQGHELERQPSYQLWHLLYSYESDNSRTGNDALLRKLETAFSIPKEYAAVLSDVVFEDSYGNLSVKAMRNILPHLQAGLDYSQACEKAGYKHSRRSLTKNELDKKEYKEKLELLPKSSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKMISPDLKIDKVIDKGIREILRTRLAKFNGDAQKAFSNLDENPIYKDEAKKITLKRVSLEGVSSVIPLHKLKDMGGKPVVGKDGKPVWGDYVQTSNNHHIAFYMDENGNLQDDVVTFFKAARRKSQGVPVIDKNYNHDKGWHFLFTMKQNEYFVFPNEATGFIPTEVDLMDEANYDMISPNLYRVQKMSKTKQGITDKRDYWFRHHLETVLNNDLKVRNSIFKQINSLKPLEGIVKVRINAIGKIVAIGEYD

SEQ ID NO: 87 - protein, 1403 aa, Chryseobacterium gallinarum
MVERILGLDLGVSSIGWALVEEDVKNPENNKIIKLGVRVNPLTIDEKTNFEKGKSITTNAGRTSARSARRNLQRFKLRRKKLLEILIHYKIIKNDAVLAETGKNTTFQTQYLRAKAAREKIELDELARVLLLINKKRGYKSSRKVQNDDDGKAIDGLSVAKELYEKNYTPGQYAYDLLKRGKKQIPDFYRSDLQNELDRIWEFQKQYHPDILTDEFKKELEGKGQRATAAIFLNRYKIYTADNKGTREEKKIQAYQWRVEALSQPLDVKEVAYVIAEINNNLNNSSGYLGAISDRSKKLYFNGQTIGEYLFEELSANPHTRLKNQVFYRQDYQDEFEKIWKIQTKFHPELTKELKEQVRDIVIFYQRKLKSQKGLISFCEFESREIEIEENGKRKRKKVGLKVAPKSSPLFQEFKIWQVLNNIEIKNEDERRYLEPEEKELLFNELNCKGNLTSQKCLELLGFKSKDAKLNFKVVEGNRTNEKLYDAFLKILELQGYNVFELLKIKEDKDEAKLSELKASADEIKGMIKEIFNANLINTSILDFNAELEGKDFENQASYQFWHLMYSYEGDNSPSGNEKLYELLEKKFGFKKEHSKILSTIVFSQEYGSLSTKAMRRIYPYIKDNKYSEACLLAGYNHSKHSLTKEELENRKLKEQLEVLPKNSLRNPVVEKILNQMINLVNATISEYGKLDGVRIELARELKKSAQEREDMAKSINEATLLHQKYATILKQEFGVVNPSRNDIIRYKLYMELTVNGYKDLYTNTKIEKENLFTDKYDIDHIIPQSRFFDDSFSNKVLVPRQSNLDKGNLTAYDFMSNKGSEREEHFLNVIKELLDKGSISKAKYEKLKKKGLEIGDGFIERDLRDTQYIAKKAKEILFEITNSVVTTSGRITDKLRKDWDLVNIMKELNLDNYRRLGLTEIVRNSKGEEKELIPDWTKRNDHRHHAMDALTVAFTTRNHIQYLNYLNARKDEKHKEHQNIYAIENIITEVIEKKNGSKTRRFKAPMNSFRHEAKQHLKEILVSHKTKNKVVTSNINKTKKKGGIHKKTELTPRGQLHKETVYGSKKFLQSREEKVSAKFDYETILMVVNPIHRNALLNRLKEYGNDPKKAFSGKNAINKNPVYLDDSKTDILSEKVTLSWYETGYTIRKSVTPDNFKDYKNLEKITDLGIKKILKERLDQFKGNAKEAFSNLDKDPIWLNEEKGIAIKTVTITGVSNAESLHFKKDHLGKEILDENGNKIPGDFVSTGNNHHLAIYLDEEEKLDDKMVTFYEAVLRVNQGLPVIDKDYNKEKGYKFLMTLKQNEMFVFPNEDFDPNEIDLLDERNLERISKHLFRVQKISKVGYGNSFVRDFVFRHHLETTVEERKELRNITYIQLKSLEGLRNIIKVRLNHLGKIVQIGEY

SEQ ID NO: 88 - protein, 1424 aa, Parabacteroides sp.
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 89 - protein, 1430 aa, Capnocytophaga canis
MKHILGLDLGTNSIGWAYVKEAENDTETSEIVDLGVRVNPLTTDEKTNFEKGKPISTNADRTLKRSARRNLQRYKLRRKELIELLKEHQLISENTILTENGKGTTFQTLELRAKSAKEKISLGELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREELAFVITEINNNLNNSSGYLGAISDRSKELYFNNETVGEYLWKQIAANPHTSLKNQVFYRQDYLDEFERIWNTQAQFYPQILTESLKKELRDVVIFYQRKLKSQKSLVSFCEFENKEIEIKKEDGTSTKKVIGLKVAPKSSPLFQEFKIWQNLNNVLIRKKGSKTKKVAKTQQAVLFEEEKTISELDLEAKQALFNELNLKGNLKADYCLEILGYSPKEWEMNYPELEGSRTNKALYEAYLKITDLEGYDAKNYLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLRDSLEVLKKNSLRQPVVEKILNQMINLVNALLKKYRTETPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRIFDDSFSNKTLSFRKTNLDKGERTAFDYMESKFGADKLEEYVARVEDLYRNNIISKAKYQKLLKKESEIGDGFVERDLRETQYIAKKAKEILLQITRNVLSTSGGITDRLREDWDLVNVMKELNLPKYRALGLTEMEDRKYGQQVEVIIDWTKRNDHRHHAMDALTVAFTKHNHIQYLNYLNARKNEKHKEHSNIMGIQQLETIKVTDKNGNEKRVFKAPMPNFRQVAKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGIAIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQTISVVKYGNAIVRDFKFRHHLETTVEDKKELQGKTYQQIKSLSPLNDIIKVRINHLGDIVSVGEY

SEQ ID NO: 90 - protein, 1535 aa, Ornithobacterium rhinotracheale
MNTILGLDLGTNSIGWALIKVLNDKTRLPLEIIDLGVVVIPTDQRTLDKFSKGESISKTAERTKQKGVRKLYERKKLRRERLHRVLNILGFLPEHYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWDSPDKIEFLKQHSIGNPIVEKIINETLKLIKDIWVIHGKSCKNFFSEIHIELSREIKSSSKKRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLNDTKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHIDTIYGIVCKKLPLKSALENYKNIIDENLKHKIKELKEVNKFDNNQIINFFKECNFIFEDNNIQKVEVYDFKDNRDKTILSSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 91 - protein, 1440 aa, Weeksella virosa
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 92 - protein, 1345 aa, Flavobacterium frigidarium
MKKILGLDLGTTSIGWSFINESENENETSSIVNTGVRIVPLTSDEEADFKKGNTISINADRTLKRGARRGLQRFKLRRDALLDIFSKINFIPTHYVYAENGSNSTFLSYQLRAKAAIEKVSKEELVQVLLMLNKKRGYKSSRKAKSADEGDAIDGMKIAKEIFENNLTPGQWVYNSLLKEGKFIPDFYRSDLQKELERIVRFQNQFHSEQMNEKLLEDIQGKTRTQTSQYFTNAIKIPLTENKGSRDEVKLQHYKWRSEALTSELDLKILAYVITEINNQINQSSGYLGAISDRSKELYFNQETVGQYQYKQLQENAHNKLKNQVFYRQDYLDEFEKIWKTQARFHPELTDKLKTEVCDITIFYQRKLKSQKHLVSFCEFEKGHKAIPKSSPLFQDFRIWQNLNNIVIKNETTKEPFVLDEDLKKIISEELLFKESMTDVQMMAFCDLKKGNHSANFKKIEGNRTNTEIFKAFEKILILEGYDELDFSKLDASDIKQIFKSAFVDLGISTAILHFDPKIQGNDFDKQGYYQFWHLLYAAEDDDKLKETLKNKYGFKENHLPYLLNINLQADYGSLSAKAIKKILPHLMDGHIYNKACLMSGYNHSSSLTTEQNNDRVLKDTLELLKKNSLRNPVVEKILNQMINVINAIIKDPEMGKPDEIRVELARELKANNEQRSDMTKAINKSTAEHDKIRQLLRTEFGIPRVTRNDIIRYKLWKETEGISIYTGKTIEASRLFTKDYDIEHIIPKSRLFDDSFSNKTICERQLNIDKSNKTAYSFLQEKLSAEDFDQFEKRVKSLFGKISRTKQNKLLMADNEIPEGFIDRQLRETQYIAKKAKEILFEVSRNVTATIGSVTDKLRDDWELVEVMKELNWKKYEKLGLTYEEKGKNGERLYKIKDWTKRNDHRHHAMDAITVAFTKPAYIKYLNTLNAQSKDDTKEIYSQYLKRDKNNKLRFIPPMENFREAAKKQLESILISYKAKNKVVTKNKNTTKKSGGTQTKIQLTPRGQLHKETVYGKLQRYETKEEKVNANFTAAHIAKVANKAYREALLKRLEENENDPKKAFTGKNSLAKTPIYISLKDNITVPEKVKLVWLEDNYTIRKDITPDNFKDLKSIAKVMDSGLKTILENRLAEYGNDPKKAFSNLDENPIWQNKEKGIAIKRVTISGVSNAQALHTKKDHLGNEILDQEGKPMPVDFVSTGNNHHVAIYRDEKGNLQEEVVSFYDAVIRRNLGLSVINKNHEKGWDFLFSMKQNEFFIFPSDSFNPHEMDLQNPTNYHLISRYIFRVQKIATKDYTFRHHLETTVEDKKELKDISSKRLGLNGINDIVKIRINHLGKIVQIGEY

SEQ ID NO: 93 - protein, 1213 aa, Rikenellaceae sp.
MEKRLGIDVGTNSLGWAIVEVDDEGCTLLDRGVDIFQEGVAREKNQEKPAVQDRTDARALRRHYFRRRLRKIALLRVLVRHDLCPALSEEQLNAWQGKGIYPLDDAFIRWQRTDDNADRNPYRDRFRCLTEELDLACREERYVLGRALYHLCQRRGFLSNRKDAGNEAEEGKVKQEIKTLSADMAAAGCEYLGEYFYRLYQRKEKIRKHYTARNEHYLAEFRAICRKQRLDEELRQALEKAIFYQRPLKSQKGLVGKCTFEKDKSRCPVSHPRFEEFRMLQFINNVRVTGPGDAEPRPLSPEEVEIVRPLFLRKSKPHFDFEDIAKKIAGKGNYACRGELLQAPYRFNCAGKSTVTGSPVSALFASVFGDDWQREICSLYTLGAGKNEEQILNDVWHVLFAFEDEERLQAWLQEKLQLSADDAKTLAAFRLPQGYASLSLNVINKILPYLRRGYRYDEAVFFANLGKVLPAEVYADPARRREVEQGISAQMDDLGDGEKTRKEERIRDYLRRYWGVEEKRLERLYHPSMIEAYPSASPNGQGLLQLGSPRIPAVRNPMAMRALFRLRVLLNELLREGKIDRGTKINIELARELNDANKRKAIERYQREREAENRKYAEEIRQQYVEATGHSIEPSEEDILKYRLWVEQGHCSLYTGKTIGISEFLGDGRRYDIEHTVPRSRGGEDAQYNKTLCEEEFNRDIKRDKLPSELANHTAILACVESCGWFERIEGLEHRVWGADRRAKSATTKSAKDFAIQDRHYWRMHLDYWRRKCEAFTMTEVPEGFSNRQGVDVGIIGRYARLYLQTVFDRVYTVKGATTAAFRRMWGLQEEYAAKERVNHVHHCIDAITIACIGSREYALWAQYVRQDELYRWGEADKPRCGKPWPTFTEDVRATADELLISHHTPDNMPKQSRKRLRVRGKVQRNDRGEVKYMQGDTARGALHQQTFYGAIERDGEIRYVVRKSLDQLLPADVEKIVDEAVRQKVREAVEAYGFKEATDPTKHTVWMNEEKQIPIRKVRILTGVKNPILLKPHRDVSVKEYKRYYHVVNDGNYCMAIYEGRDRQGRLKRTFEIVNKLEAARYFKRSADRESRPDLVPLSDVNGYSLKYLLKTGTMVLFYENSPDELYECSVGELAKRLYKVVGMAQDGRVQFLFHQEARDQKAVTAECGMGISVFDARHPAPKLRIRVSNFKMFVEGYDFELTVTGEVKFKR

SEQ ID NO: 94 - protein, 1459 aa, Jejuia pallidilutea
MSKLGLDLGSSSVGWAKNVGGKIVKSGVITFNTGMSKGQSGGYVSPTRERREARAKRNLIKSRKYRKWELLKVLAEMKFVPLDEQELQIWSKYKKGSTRRFPENEKFLKWLACDFTYEEGENYKNPYVLRVKALNHIVTKHEFGRALYHIVQRRGYKDIGETDKETENQIKRRNDDGFKKALDIHGTVAKALNEEFLKKGKRARNQYPLREEYKHELEELCKAQGYNIQKEGKEGYKNKFVKSLWKAIIWQQPLKTQRGNIGKCSLEPTKPRSPISHPIFEIFRSWQFINTIRYYDDDGEKQVLSQKIKQALFYEKFLKKDSNFKFEEIRKFLDKRFQKAKRYNYPIDRKTGKYDTSVSGMPVCKGLINVFGEKAQSALDDMELYQINNAPKIIDKYSIYDLWHIIFEFDAEHLDKFATEKLKIQNKIVTRKKKQISISPLVELKEKFIQGYADLSLKALCKIIPFLKKGHLYNDAVILAKIPELLDTQWQEKRDLINEVLEKSNKLYNERKAIINIANNLIDKHKGLNHSEKFAYKDFEYALVPDDIEEIEKACVGYFGEKSWIKNKKKEEIIKEVGFEYQDYFHDTKRAYRKFPNFTEIFKDDLKENGINLKGELYHHSNRKNIYDNTLEINHETGEKYLPTYKDTGIEILPVPYIDSIKNPMFNKSMSILRKLINELIVAGEVDDNTEIIVELARELNDNNKRAAIERYQNLRKNNREKYREFLKEFKNRENINLNVEESISAFELWSEQTFEETNDENGKRISNKGHIEILNEKAALKRYELWMEQKGQCMYTGKMISITQLFSNDIDIMHTIPRWLLPDNTMANMTVGFSKYNRDLQKEKLPKQCDNYSVDVDGWGTSIEPRLEIWKKERDKWKSLFESRRKPKGNEDEEKKNKRIQEKHYFKMHLIYWNDKIERFEADEVKDSWARRQLVDTQMISRYAREYLKLYFKKVSVQKGTVTSDFRKLFGFQEEDEIKSRDKHTHHAIDASVLTLIPVNSSKREQILKNYFKSQEDKDKLSLKKLRASVKPSSDFNPQELIRKIEEKTLIVNYQKDKIINQSIKKVRKRGKIQYVKDKQGEFVLDKEGNRIIKYAKGDTLRSELFAQTYLGKIKDVERYDDSSPKRNTENTDWIYKKGKDEFIFVKRENIDKVKSSDKLIKSIIDPVIRNLVEEQKKNTIVKDYQGNVIRHIRIRTKSGREVKERINYRSRYDYKNKFYSEAGKIPYAVLLQKSINGEIEREMIPVASFEVAKVFKKHRKFNPELYMNEFHPDIGNWDKKNWLKVGQKVIVLKNDKEFEKRDDIDFQHKRMYVITQFSDGGIWLQYHLNAQSKDDVKKSISLAKDKLLRKYEIQYNIPEVIEDESIQDRKNRTADYNNRRFRFDTISKSFRLTTLMETIGEKRTKKIKAELDKYKAIPSSIEIEGETALLKMSKENWNYLYEGTDFEVTILGKLNWL

SEQ ID NO: 95 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 96 - protein, 1458 aa, Salinispira pacifica
MPYTLGLDLGSSSLGWALVDEEQQNIIKTGVRVFPGAATDIGTGKESYKNQDRRLSRQARRQTLRRKQRRIVLLRTLVDFKMCPLSKDELESYAKYRKGKKQEFPSSSEFNSWLKLNPYELRDRALHEDISRFEFGRILYHIIHHRGFKTGRKSNEDGALYKGNEDTVGVDETKNLLQQYATLGEYLNSLRIKSDGNERLRGRYTLRNWYVDEFNKIWERQAGKLGLENETVHSRNKRYYGPAGSSEHRRKLQAYKKAGISFEIEGDFICREQTVSLKDYLGNPDKGILFYQKPLKSQKHLLSKCRYEKRKSVCQISHPEFEYYRAMQFANQIEYGAGEKLNETDRKDVIILLLSKDKAVKMSDLKKKIQKTGVQFNYADDHKVPGSPTTAFISKVTDTSNVENIDWELFHSIWNDLVFYDKSEKLKEKFQRSYNIDVSIEQLNKYKINTDYSSLSLKAVRNINPFLQMGMLYNDAVIFAGIRRVIGEKSFDANADEIISHVSKLKEKNNRDVNQSFTDALREYVMQTFNISMNQTYKLYHHSQEMSVQNNRYYLSELPNLRNPIVQQALQELRTLVNTLVEQYLPDGEQFSKIKVELARELKLPRDVRRRMHWENNQRAERNNDAKIELQKFGLSPSRENIQKYILYKEIQNSVQGQSVQCPYTGQSLAITDVFGNDNKVQVEHIIPYSISLDDSLSNKTLCIAEENGKKGEKTPYQFYKSDPDHWEVVKARAFTLLPYEKAKRFVSTRDYEPEAFLQRQLNDTRYISKAARDYLSTICDQVYVFPGSLTAKVRRMWGLNSILSPPIKTNFEGNAGMYWAVMNDDGVIIELSEQELPPPAIRASDILISGEMKNGIFKVDRKFTGQSQTREVSVEHRTYDSPGWMVYSLLSVEKYLPLFSKLPSQDTKSIWLKGRAQVKDRESPSLMLNSLPVKLMLPPGEYDDNAPYWVNIPVNGELRWEKRGEKPGKNELLIKRTKHRDGKVEAFIDKRKCLFDIPPQDNKSALIIPLDLQEILQVVRMFTPTPAIAEHQFLIKGKIDQSYRFTAESNFRIALDAPEGTPSGPAFAIANCEPRDMRFYPKKNIKPKNGKGKNVLSGFVFQEDGSLVFNPGKNRMDHRHHAIDALTIALLNTGQLRELSGYFLKIKKRQRYSAPKPQFPLPWDNFRADALNSINSILVVHRQNREIIKRIKKNTRLNGRTYVSQGMSVRGQLHKDTVYGKHYIPGSDEPGYHVRKQITDLTSLSKIADAGTHEILRTFVEENGYSIDEKEKVKGEWFTKGNDYQVIMPSSGKPGNPIKKVRIRENLGNAVQWHTGINQYVNPRNNYAFIIYRDSDGNYKEHPVTFWDAVQARLAGKSVYQLPEPGKIITTLHINDTFLLGLGDEQLQGDLPQELVSRHLYRVQKLSSMYYCFRLHTESTLDRDFEPYYLGIQSFKAWKEQNPLRVKVATTGEVNLE

SEQ ID NO: 97 - protein, 1070 aa, Sulfitobacter donghicola
MRLGLDIGSTSIGWWIYETTDGQITSVIDGGVRIFSDGRDPKSKGSLAVDRRVARAQRRRRDRYLRRKAALMKRMAEVGLMPSDPKQAKQLEALDPYELRARGLDETLELTELGRALFHLNQRRGFKSNRKTDAGDNESGKIIDATARLDWAMRDHRARTYGEFLHMRRQKADTPRTTPAVRTRLTIAARDGAEKEESGYDFYPDRQHLRDEFDALWEAQAEYHGVLTEDLRDEIGTIIFHQRPLKTPKVGKCLFTNEERVASAHPLNQRRILVETVNALRVAQLGEVARALTLEERDTILHALDNKAHTKSLSGMSIKLKALGKVIKLRSGQYFTLETANRDAIACDPVRASLSKPDRIGSYWSTLDHNAQWEVVNRIRAVQSDADHRELVAWLVSQHRLAAEHAEGAAYAPLPDGYSRLGITATKRILAALEANVIPYSKAVESCGWHHSDERTGEVLDRLPYYGEILDRHVIPGTYDDSDDDITRFGRITNPTVHIGLNQLRRLVNRIIEVHGKPDEIVVELARDLKLSQDQKADVERTIKKNTQAAIRRGEKLEEMGVPNTGGNRMVLRLWEDLNDDDVMKRFCPYTGQRISAGMLFDGSCDVDHILPFSRTLDDGFTNKTLCLKEANRKKRNYAPHEAAEKGLLDRDAMDSVAKYLPDNKAWRFAPDAIERFEGERDFTARALKDTQYLSRLARTYLDALYDGGDDKSHVWVVPGRLTEMLRRHWGLNGLEALADSDEKTVKRKNRTDHRHHAIDAAVVAATDRSLIQKISKIAASDEQAGAEDTLKSTPPPWDSFRDDIAAQLQNITVSHRADHGRTDSLAKGRGEDTTSGALHEATALGIIDETHVTVRIPIESLKSGHLIEGSRNGYIRDPYLRDQLTLATKNGSDKDFTTVLQKFFDRSKRYGGTRRVRIIKTLQDTARISVPHNAPIKAYKGGSNHAFEIWRLPNGKIESQVITTWEHHNLTEPKRPHPAAKRIIRLHKTDMVAIERDGKTVICFVQKTDPSNGAFLVPHFEANADGRKRKNEPVEWYQMSANSLIKADLRRVGVDEMGRVRDPGPPPIR

SEQ ID NO: 98 - protein, 1044 aa, Mucispirillum schaedleri
MAEKKFKYRLGLDLGTNSIGWCMLRLNKDNEPAAVIKSGVRIFHDGRNEKTKEPLAVVRRNARSIRRNLDRKISRRNHLLNTLVKYFLLPSNEIERKALAVLNPYELRSRAVNERLELFELGRLLMHLSKRRGFKSNRKVDKEDSSGKIKPAIERLKNKMQETNKKTAGEYLYSLMQNGKPVRARLGRIDGSNGYEIYLDRALIEEEYNLIMNEQKKHHKELTDDIINEIFNIIFYQRPLKKQIIGKCSLTGEDTKLKKAHVLAQDFILLQKVQDLRVFDDNQLEFRPLSNDEKDIIKRELRKKKEVSYENIRKLLKKYYENVKYGMFSHETLYKKLQGNKTNALMSDKEIIGDSWYSLSPEVQYDIIEELYSDKDNDELSKLYSEKFNLNESQINGLLNKAIYRLDSGYIRYGKTAVTNLNSIMDKDNLNLHDAREEAGYEKENKQDASEYLEYYGKVLPDSVVDPQIENPKNDEERYGKIANPTVHAALNQLRKLVNELIKLYGKPEQIVIELARDLKNSRKAKDVINKKIAENRKLNEEVDKTLQEYSEKYNTHIVKNKLNRDKVKLWRELGKDPLERKCIYTGEQINIAKLFSDEVQIEHIVPYSKTLDDSFNNKTLSMKQANYYKGNKTPYEAFKDSKDGYNYDDIIARAKLLNNDNKFKRFTKDAMDIYNRDGKDFIARQLSDTQYLSTRALIYLQSLYEKAHHSSIWTIPGQLTALIRNYLGLNTLISNDKNKNRNDHRHHAVDAFVVAVTSRSLLQKISYAASLQEDLDNRNVSSYRNKLLEKMPEPFPNYRKSLELAIDNIKTSHKADRSISGKLHEDTAYGIVENDDKYNVVTRWTVDKFKEQKHFETIRDNELKEIACSDKELFAKIVETRKIKSIRKLAKENPVIKIKDKSGRDYKAFAGGNNICVEIYEVDGVRKSEVIQLFDAAQKGFMPEWMKKYPNGKLLMRLFKGDVIGFIENRKYNYYTIKGISIADQNLKLLAINKAEGIFKKGLNILFDSNNKNSLNAKQFNISVTGIVTKKKTADVNFWKNRK

SEQ ID NO: 99 - protein, 1118 aa, Mesorhizobium sp.
MGTRYSFDIGTNSIGWAVWRTGRDPKGIFGEKDAPLELLGAGVRLFKDGRNPKDGQSLATMRRIPRQARKRRDRFVLRREALVAALIEAGLMPASEKERKALADLDPYQLRAAGLDKALAPHELGRAIFHLHQRRGFKSNRKTDRKSDDRDKGKIATASAALAKKFEDENARTFGEFLWRRHRDPDMKRQAVLKAHDPAKGKPDLRAAKLRQPTRIRLEGQGATALYEFYPTREMLCHEFDALWEAQARHHPMLLTREAGDKIRSILFRQRELKPPLIGLCTFEYAAGEKESRLPKALPSVQAREIYERLGHIRLSTGSGTDRPLKSSERDDLATALLHCGLTKIKVSKTKGLAFKTEFRKALRLGGEVRINFEEMGEEGLVDLRTNRLLVQDDHYGPRWRALSWSGKDAFVKKLLEATDDDKLVARLMTEDGLSAVQARNAASIPLPDGYSRLGPTANAAILQALIDSRDENGFVVTYDKAVRRAGERLGKDWHHSDERDGEILDALPYYGKVLQRHILPGMMDPADRKDEAKFYGRIMNPSVHIGLNQLRRLVNALIERFGPPDQIVVELARDLKMSAREKEQEQRRNRDNREANEKRTKKLVELGQDNNGENRARLKLYDEQQRAGNGVAHCPFTLDPIGITQLFSPEIEIEHVLPRSRTLDDSAANKVLCFRTINRIKRGKTPWEAFHADPKWPDIAANAEKLPPNKRWRFREDAMDVFEARTSGKMDKTTLEQMGLTTGFQARHLNETKHMSRLAKAYLGKICDPDAVYVTPGALTSLLRGKWGLNSILSDDNLKDRTDHRHHAIDAITIGAMTRSLLLELNTLAGKAEQSDYDDVVGKVPWPFDNFRDAVRSVVDRVVVSNKPEHGKQGALHEDTAYGIVGDEAEAEEIGNLVRRKLLVDLTPGEVDRIRDAGLRKAMQAAVAPSRDARGKVSDAKGFAAALDTFAKAQGMRRIRVGKEDMSAVTIHDRQTDKAYKAVAPGENHHVDVVQMRDGAWKGFAVTVFEANQKDFRPQWEREKLGGKLVMRLHKGDAVELESSGVRLVKFVQQIWMKSNLVLLTEHNEGGDLQKRHQDADDPFRWDFANIGKLKERGCVAVKVDELGRVTKRISNT

SEQ ID NO: 100 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 101 - protein, 1087 aa, Geobacillus sp.
MRYKIGLDIGITSVGWAVINLDIPRIEDLGVRIFDRAENPQTGESLALPRRLARSARRRLRRRKHRLERIRRLLIREGVLTKEELDKLFEEKHEIDVWQLRVEALDRKLNNDELVRVLLHLAKRRGFKSNRQSERSNKENSTMLKHIEENRAILSGYRTVGEMIVKDPKFALHKRNKGENYTNTIARDDLEREIRLIFSKQREFGNMSCTEEFENEYIAIWASQRPVASKDDIEKKVGFCTFEPKEKRAPKATYTFQSFIAWEHINKLRLISPSGTRGLTDEERRLLYEQAFQKNKITYHDIRTLLHLPDDTYFKGIVYDWGESLKQNENIRFLELDAYHQIRKAIDKVYGKGKSSSFLPIDFDTFGYALTLFKDDADIRSYLRNEYEQNGKRIANLANKVYDNELIEELLNLSFTKFGHLSLKALRNILPYMEQGEVYSSACEKAGYTFTGPKKKQKTVLLPTIPPIVNPVVMRALTQARKVVNAIIKKYGSPVSIHIELARDLSQTFDERRKTKREQDENRKRNETAIRQLMEYGLTLNPTGLDIVKFKLWSEQNGRCAYSLQPIEIERLLEPGYVEVDHVIPYSRSLDDSYTNKVLVLTKENREKGNRIPAEYLGVGTERWQQFETFVLTNKQFSKKKRDRLLRLHYDENEEMEFKSRNLNDTRYISRFFANFIREHLKFAESDDKQKVYTVNGRVTSHLRSRWDFNKNREESDLHHAVDAAIVACTTPSDIAKVTAFYQRREQNKELAKKTEPQFPQPWPHFADELRARLSKHPKESIKALNLGNYDDQKLESLQPVFVSRMPKRSVTGAAHQETLRRYIGIDERSGKIQTVVKTKLSEIKLDASGHFPMYGKESDPRTYEAIRQRLLEHNNDPKKAFQEPLYKPKKNGEPGPIIRTVKIIDTKNQVIPLNDGKTVAYNSNIVRIDVFEKDGKYYCVPVYTMDIMKGVLPNKAIEPNKPYSEWKEMTEDYTFRFSLYPNDLIRIELPREKTVKTAAGEEINIKDMFVYYKTIDSANGGLELISHDNSFSLRGVGSRTLKRFEKYQVDVLGNIYKVRGEKRVGLASSAHSKTGETIRPLQSTRD

SEQ ID NO: 102 - protein, 1074 aa, Bacillus okhensis
MTDTRDYRIGLDIGTNSIGWAIIELEYNGEQYDKKGLIDAGVRMFDKAEIPKTGASLAEPRRLARSTRRRLNRRADRKKSIRRLIVEQDILNEAELQVLYQEKELLDIWTIRVEALDRRLSRTEWARLLIQLAQRRGYRSARKSEENDKETGVVLQNIRENKKLIDGYRTVGEMWVKDPRFQGRRHNSRSEYVFNVTREMLEEEIRTLFHTQRELGLSFASKEMEESYLSIWGKQLPFASGKDILKRVGFCTLEEQERRFPKATFTFQYFMVLDKLNRLRIKPSMRPLTEEERKSTLHYLFDRDDLSKKKTPPKVMYKEIRKQLNLAATETFNELTYDPNESMTKNENVLFVNLDAYYRIKQQCDLHNERYGPRDYDALGYALTVYKTDKDIRQYLRNKTNLANRIYSEELISNLLSQSYATFGHISKKALLAILPSMEKGDTFKVAADKMGYDTTGLQLVKKELLLPVIPNDITNPVVMRALTQARKVVNAIIKRLGEQPLSIHIELARDLLKGHDERRKISNEYKQNHKRNAGAYTILNENGIINPRGYDIVRYKLWQEQKQKCAYSGKVIPSETFFGELKKERGQGAPTLDVDHIIPYSKCFNDSYSNKVLVYSDENRKKGNHLPFDYLKESPSRWEEFETYVLTNEFPRAKRERLLKKQFSEDEESVMKERHLNDTRYASRYFKQFVEKSLQFKKSKNQFHKKRVETVAGRVTAHFRQRWGFEKHREGTHLHHALDAIVVACTDAAMIQALSLYHKQKEEGKKGYIKRFPLPWITFRDDVLNKLSESAIPEQIYSALVSGTTLPSYMLVSRMPRRSVTGPVHKETISKDGGVDEKGKTLIVKKVQLQDIKFNKNGDFLMYMEETDPATYKAIKERYLSFNKDAKKAFQDPLYKPSKKGKPNQIKSVKVIVEKKAHVRKVNGGVAENGDLIRIDFFQKEGKFFMVPLYTYDTIQSDLPNRYVVSGKGYQLWPQLTNEHKFIQSVHPYELLRVVKRSGDDRFLYLASINISNNVLKFIEPNFPHNDYIEISLGTIKHMEKYDVNVLGQVSLKATGPRLGFNNMKAQKNKVKG

SEQ ID NO: 103 - protein, 1049 aa, Tistrella mobilis
MINERLTFGIDLGIGSCGWAVLRHADAAGEPGVIEGLGSWCFDVPETSKERIPTNQVRRSNRLLRRVIRRRRNRMAEIRRLFHAQGLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLSHTAQVVSKAGFNALVTELGESIANPIARKALTEGLKQIRAMCARWGLPGAIHIELAREVGNSIEKRRELESQRETTTKRRQTERDEIRGLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQRFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEAQVFERRGLADLKEADLDRVKDPERNQAIIEAVRAWILAGRPADAPPRSPRGDVIVKLRTAPAKKIKPAVPVRGGTADRGDMVRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 104 - protein, 1060 aa, Kingella kingae
MAAKSLNYILGLDLGIASCGWAVVEMDEQENPLRLIDVGVRTFEEAENPKDGSSLAETRRLARAQRRLISRRANRMNKLCRLLKQENVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQGQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 105 - protein, 1065 aa, Clostridium perfringens
MNKDINYALGLDIGITSVGWAVINLDLNRIEDLGVRIFNAAENLKDGSSLALPRRLARGRRRLLRRKAYRVERVRKLILKNNILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 106 - protein, 1069 aa, Neisseria sp.
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGRLRNKGGDYTHTFNRLDLQKELHLLFERQCALGNPFASAELQSKVDELLMTQRSALQGEAVLKMLGKCTFEPSEYKAAKNTYSAERFIWLTKLNNLRILYNGEDRALDEGERKQLLDEPYKKAKLTYKQVRSILNLPESAVFKGLRYGKDSDGLKAENGALMEMKAYHKIRTVLEKAGLKGEWENRIRNPEILDQIGTAFSVYKTDEDIKAELAALRLPENVLDALLAGLNFDKFIQLSLKALSNILPLMERGIRYDEACKEVYGDHRALAESKNQMLLPQIPANEIRNPVVLRTLTQARKVINAIIRRYGSPQRVHIETARELGKSFKDRKEIEKRQEENRKERERAAEHFKELFPRFTGEPKSGDILKLRLYQQQQGKCLYSGIPIDLGRLNEKGYVEIDHALPFSRTWDDSFNNKVLVLGSENQKKRNQTPYEYLDGARDSQRWREFQARVQGCRFPYAKKQRIQTAKLDSKTEQGFLERNLNDTRYIARFLCGFIEKSLHLQGAGKRRVFASNGQITALLRGLWGLKKVREDNDRHHALDAIVVACSTVSMQQKITKAMQRRETLETINTETGEVKTRIPQPWDFFRQEVMIRVFSDAPREELAEKLNSRPEALHDFVSPLFVSRAPNRKMTGQGHLETVKSAKRLSENISVVKKPLTALKLKDIENIVGYPDREPALYRALQERLQAYKDDPAKAFAEPFYKPAKDGGQGSLVKAVRIIENTKHGLKVRNGITDTNGDMVRADVYQKADKKGKRQYFIVPVYAWQVEKNELPTVDCKGYEIDDTYEFCFSLYKYDIIEIQNPDNMSKELRVYYINCDSSDGRFWLAHHDKSAKEQQFRISTQNQPIIKKYQVDPLGKEIRLCKAEKRTELNGKKKK

SEQ ID NO: 107 - protein, 1001 aa, Campylobacter coli
MKILGFDIGINSIGWAFVEDNQLQDCGVRLFTKAEDPKTRESLALPRRNARSNRRRLGRRRSRLIALKHIISKELKLNYQDYIANNGELPKAYEGRLISPYELRYKALNEKIEPKDLARVILHIAKHRGYMNKNEKKSSDNEKGKILSALKTNALKLEKYQSVGEYFYKEFFQKYRENTKDFINIRNKEGSYENCVLASDLEKELKLILEKQKEWGYSYNDNFIKEILKVAFFQRPLKDFSYLVGACTFFEDEKRACKNSYSAWEFVALTKIINELKSLEKESGELVSSQIINEILNHVLDKGSITYKKFREYIKLHESMKFKSLKYDKDNVESTKLIEFRKLVEFKKALGEHSLSREELDQIATYITLIKDNEKLKITLEKYSLNNEQIKNLLEIDFNDHINLSFKALNLILPLMKEGKRYDEACKLLNLKTKSNNQKFDFLPAFCDSIFAQELTNPIVNRAISEYRKVLNALLKKYGKMHKIHIELARDIGLSKKLRAKIEKEQKENYENNIWALNECENFGLKANAKNILKLKLWKEQKEFCIYSGKKISIEHLRDEKALEVDHIYPYSRSFDDSFLNKVLVFTKENQEKLNKTPFEAFGANEERWSKIQALAQNLPYKKKNKILDEAFKGKQQQDFISRNLNDTRYISTLIVKYTKEYLDFLPLDEKEDINLKSGEKGSKIHVQTINGMLTSVLRHTWGFAQKDRNNHLHHALDATIVAYSTNAIIKAFSDFKKEQELLKAKLYAKELTNDSYKHQAKFFEPFEGFREQILNQINKLFVSKPPRKRARGALHKETFYPKDEMIKKYNSQEGVEIALNCGKIRKIGTKYVENDTMVRIDIFKKQNKFYAIPIYTMDFALGVLPNKIVIAGKDKKGNPKQWQEIDESYEFCFSLHKDDLVLIQKKDMQEPEFAYYNSFDIGNSSICVEKHDNKFENLTDNQKLLFVNAKEGSVKAEKLGIQGLKIFEKYIITPLGEKIKADFKPREDIALKTSKKHGIR

SEQ ID NO: 108 - protein, 1048 aa, Sulfurospirillum sp.
MVEKILGIDLGISSLGWAVVEYDKDNDENNKIIDCGVRLFTAAETPKEKESPNKARRDARGLRRVIKRRRVRMNTIKNLLITYKLIDKTLLDEEMGMFHSQSNRVDVWKLRHDALYHLLSGDELARVLIHIAKHRGYKFLGDDESDEESGKVKKAGAELKKKFLEAGCQSVGEWLWKERGLQGKKRNKSGDYEISIPRDFLVEEIQRIFETQQKFGSTFATSELQKAYTDIAFYVKPMQSIEDMVGYCTFYPKIKSKNQDGEKRAPKASPSAEQFVILSKIFSTIVIDENKQEKKLIELKSIEQLIQIARSKETLKYKQLRKELNLAKDISFKSISDEEKTWINLVGNAKFKKILGLNYETFLKNTEISDEIAKILTYDKTFEQKETKLKNLLVNIDWIDNNHIAELAKLSFSQFNQLSLKAIKIISKIMIEGYARYDEAVQYAFENNLLPKPSHEKSILLPPLKETNIAILNPTVIRAFAQFRQVANALVSKYGSFDKVHFELAREVNTKEDRKRWEKDRDKNEKMHRQITEKLVEEGVKPSYKNILKSKLRSEQKDTCPYCQKNLHYPMIFEDGYAEIDHILPLSQSQDDSYVNKVLVHSACNQNKKNRTPFEWFQDEKKDWDTFKSYILMESTLGEKKRNYLIKENFSDPQSRKEFISRNLNDTRYMSKAIKTYCENHWKLSHDDDKLRIQVRSGKLTSTLRHQWGLDNKNRETHTHHAMDAIMIAFSTQGMVKKLSDYFAKKEAKVEKDKPVLITPIKQFKEAVEQATTLERQESIQTKAGDTITLNRLLISRPPRASVTGAAHEQTAKPYPRIKPIKNKYKRRRIPIDEDKFELFRNDKVASGNDKNFYNSSTIPRVDIYKKDDKYHVVPIYLSDMTKAEVPNKSLGTNPEGMDEKYFCFSVFKNDLIELETKATPKKPSKKLLGYFKQLNGANFILNSIHNGIIDGFVCSPITLFKQQKDMCKKCLPEDRAIGNCSQETLEFWEAENIKVPKKDFECDQGIKFAIAVRKYTIDPLGYYHEVKGEKLLGTIPQGAKKHPKRQK

SEQ ID NO: 109 - protein, 1115 aa, Dechloromonas denitrificans
MSATYTIGLDIGIASVGWCAFGETHILDLGVRAFDKAETAKEGESLNLARRNARLMRRRLFRRTWRLKKLARQLKSEGLIADTKLFKPELPFSKSLWQLRVDGLDRRLNDEEWARVIYHLCKHRGFHWISRAEAKQAEGDSKSEGGKVKQGLAGTAKLMDEKGYRSAAEMVLAEFPQAQRNKQGEYQKALSRELLAKELALLFAQQREYGNLHTPGALETAILGNGDKKSGLFWQQKPALAGTDLLKMLGTCTFEKGEYRAPKASFTAERHVWLTRLNNLRIVTDGVTRQLTEQERQLCLPLPYRQAGDLTYKQLGSALAKAGLLEAGGFKFTGLAYPTEAQKAEGKAKDPESATLVKIPAWHELRQTLTKGGLNDEWEKLAGDALCGQPEIFDKIAWVLSVYKDDDEVRAELAKLALPNPQALTEALLNIRFDKFHSLSLKALRAIVPHMEQGLRYDEACVQAGYHHSQLLKVGEGEHKYLPPLYDGRDGDGRMIFAEDADIPRNPVVLRSLNQARKVVNAIIRRYGSPSAVHIEMARDLSRPFDERNKIKKDQDEYQARNQRDREQFSELFGHPPKGLEFEKWRLYREQNGQCAYSQRPLTASGNVAEIFLDGSTEIDHALPYSRSFDDSKNNKVLVLTRENRDKGNRTPYEYLGGAENSESWQRFVSFVESNKAYRLAKRTRLLRKDFGAKESEEFRERNLNDTRYVCRFFKNYVEQHLKLAEGSETKRCVVVSGQLTNFLRARWGLLKVRSDSDRHHALDAAVVAACSHSMVQRLSNYSRTRELEQVRDGFVDIETGEIVNPAMHQQLREHFPDPWPYFRHELEARLKIDSPELLREEMARLGSYSEEELKVLKPLFVSRAPQRRNGGAAHKDTIYGQPEKLKKNGSVTQKVALTSLTLKDIDLLADPHRNAKLYGAIRERLEAHGGKGDKAFPATNPLRKPDKEGNPTGPIVRTVTKVIDKLSGIPVRGGIAKNDTMLRVDVFTKGGKFHLVPVYVHHRVTGLPNRAIIAFKDEDEWTLIDDSFDWCFSLYPNDLLRIKLKKESHSGYYSSCNRSTGAVNLWAHDRNVNVGKDGFIESIGVKMAVSIEKLHVDTLGNIYPAPPEKRRGLA

SEQ ID NO: 110 - protein, 1137 aa, Nitratifractor salsuginis
MEDRIVKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 111 - protein, 1134 aa, Enterococcus cecorum
MKYIESVSIGFDIGVGSVGYAVINSKTKQILESGVSIFPAAVAQKNVERRESRQSRRLRRRRVNRLNDLKKLLKKNGFIPSPNKNPYEIRVRGLEHQLSRDEIAIAVLHIAKRRGISYSLDDVVDENVTDFKGKIAKNQEALKNKTPGEIQYERLLKYGKVRGTVTNYVEYDEQPEYFLNVFPNSAYVDEAKRILTCQKQYYPEITDDLIENIVKIISRKRAYYIGPGNEKSRTDYGIYRTNGETLENIFEILIGKDSVNPDELRAPANSLTAQVYNLLNDLTNIRYNGSERLTPEQKQDILSELLTTEKTVQMLNVIAKKVNVKKEEISGFRTKKDDKPDFHTLEVYRKVRKHMLNKGIDINEWPTECFDELAFIFNLNTEIGEIRNRISEKVVPKYDFITNQIVDDLLEDPKIFAISTSQKWHRFSIKTMNVLIPELLNGYNEQMTILTRMGLLEDSKNDYSNIDKIDIKNVTENIYNPVVRKSIKKCLKIFNELYKKYPNISDVVIELPREDNPEDARKLIKKMQKENLVEKDTSLEAFRKEANLSENGLIDFLRKGKNRALKIRLWYQQEGKCLYTGEPILAEDLCKNEANYDIDHIIPISVSFDDSINNKVLCSSHFNRFEKEKKTPFEYFSNKSSHLGRYSNFDEFRASVNANKRISDVKRKNLLSKELLSDLDTRKKFIARNLVDTRYASRVVFNELTQFFASKKADTKVAVIRGKFTSQLRRAWQLNKSRDTYHHHAVDAALIGVTPFLKIWRSGKTIYPRKMTEAQTDFELNEITTNDEFKESYYQLPCPQFLDYLTQMQENLKINFEVDKKMNRKISDAMIYSSRKKKLSKDKKEKEYSLGTINDIYSDAGYSKFKNIYKKDKEKFLMYHLDHKSFEILEDIISQYPDKEEYIDSEGKVKQRAVSPFEIYRRKYGYIRKYSKKNNGPIIKNMKYYNENLPKIYIDITPKQSIDKKVYLTNISPWRTDVYYNRSQNSYHIMGIKYSDLRYIDGKYGIPKNVYEKIKLREKIPSESEFCFSLYKNDRVKIIDPNKNEEIELRFNSRTLPSVLNYVEFKPLFQESYNSLTLLPVFSKTTSEGRIIKKFTREDNIVYKVNTDELGNPYYILKESQNPKNIIDNSNKTE

SEQ ID NO: 112 - protein, 1142 aa, Facklamia hominis
MYSVGLDIGIASCGYSIINDVNGNIVELGTLLFKSRNSDNNEERRTNRGSRRLINRRRTRLDDGKKLLAEKGFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNKYAEKNQIPVKELLEQIYNPTVTKSVHQSIKLFNEIIEKYGKNNISYVTIEMPRDKNDQDQKDTIKRINKLNSERKNDSEKYFLERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQRGFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNRKISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNSWRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 113 - protein, 1122 aa, Streptococcus sinensis
MNGKILGLDIGVASVGVGILDKKTGEIIHASSRIFPAATADSNVERRGFRQGRRLGRRKKHRKVRLADLFSDTGLITDFSKVSINLNPYELRIKGLNEKLTNEELFIALKNIVKRRGISYLDDANEDGESSSSEYGKAVEENRKLLADKTPGQIQLERFEKYGQVRGDFTIEENGEKHRLLNVFSTSAYKKEAERILTKQQDYNQDITDEFIQAYLTILTGKRKYYHGPGNEKSRTDYGRFRTDGTTLDNIFGILIGKCTFYPEEYRAAKASYTAQEFNLLNDLNNLTVPTETKKLSEEQKRQIIEYAKGAKTLGAATLLKYIAKLVDGSVEDIKGYRIDKSEKPEMHTFDIYRKMQTLETVDVEKLSREVLDELAHILTLNTEREGIEEAIKVSFIKREFEQDQIAELVSFRKSNSSLFGKGWHNFSIKLMTELIPELYETSEEQMTILTRLGKQKTKARSKRTKYIDEKELTDEIYNPVVAKSVRQAIKIINLATKKYGVFDNIVIEMARENNEEDAKKDYVKRQKANEDEKNAAMEKAAHQYNGKKELPDNVFHGHKELATKIRLWHQQGEKCLYTGKNIPISDLIHNQYKYEIDHILPLSLSFDDSLANKVLVLATANQEKGQRTPFQALDSMDDAWSYREFKAYVRGARALSNKKKDYLLNEEDINKIEVKQKFIERNLVDTRYSSRVVLNALQDFYKLNDFDTKISVVRGQFTSQLRRKWRIDKSRETYHHHAVDALIIAASSQLRLWKKQGNPLISYKENQFVDSETGEIISLTDDEYKELVFRAPYDHFVDTVSSKKFEDRILFSYQVDSKYNRKISDATIYSTRKAKLGKDKSEETYVLGKIKDIYTQTGYDAFIKLYKKDKSKFLMYHKDPITFEKVIEEILKTYPDKEINEKGKEVACNPFEKYRQENGPLRKYSKKGKGPEIKSLKYYDNKLGNHIDITPDNSENQVILQSLKPWRTDVYFNHKTKIYELMGLKYSDLSFEKGSGKYRISLDKYNVIKKKEGVHKESEFKFTLYKNDLILIKDLEKSEQQLFRYNSRNDTSKHYVELKPYDKAKFEGNQPLMALFGNVAKGGQCLKGLNKANISIYKVQTDVLGNKRFIKKEGDAPKLEF

SEQ ID NO: 114 - protein, 1091 aa, eubacterium dolichum
MGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 115 - protein, 1130 aa, Streptococcus macedonicus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDYLSREVLDKLAGILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKEGDKPKLDFKNNKK

SEQ ID NO: 116 - protein, 1107 aa, Turicibacter sp.
MGYTLGLDIGIASVGFGLIDNVDGKILESGVRLFSSADPDNNQTRRSSRQARRLNRRKVHRLERVAHLLEEAGFEKGEVLAPTPYHLRVKGLTEKLSKPEVYAALYNLMKHRGISYLEDVELDEADSSSVSQNVELLKEYYPCEIQLERYEEYGQIRGIIETYNKDGEKESLVNIFPTGAYKKEAEAIILKQGQFYPELDKVFLEKFTEILTVKRPYYVGPGNKKSRTDYGIYRENGETLENLFDILIGKCTIYPQEARAAKFSYTAQLFDFLNDMNNISIAGEKLTEVQKREIYHQIMSSKTVNMMKIITKVTGCLKEEVTGYRVDSKYKAEFHSFASYRQFRNKMLDYGFDVQTLNVEMFDKLAAKLTLNTEYHQIITQLESLNLGLSKELIEKIADFRKKNRSLFSKWHSLSLKAMNEVVDELWSTSKNQMQIFSELGGFKSNIEVFKGLKYIPLDAMVDEIYNPVVRCSIRESIKIINALLKKYGALDKVVIEMPRDSNEKEEKDRITKLNKENDNKKKQAIEKARNEYGFGEEAYRQQNDLNTKLRLWYEQKQRCLYSGEIIKIFDLIKNPHLFDIDHIIPKSISYDDSLSNKVLCYATENREKGNLTPYRYFKRKASLTWNYEAYKSYVIELYKDGKGDLSRTKLELLLFEEDINKYEVRQRFINRNLVDTRYASKVVLNTLQDFMKENYPTTTVEVVRGKFTAQLRRHWGIRKNRDENHAHHAIDALIIACVPHLSLWKEQKKVFSTDEFRVDETTGEIIEQSYNQLTYQEPFSQFFYQLEKVSIDCRYSYKVDRKFNRQVADATIYSTRQGIVKQTSGDKSFTLDSNSKEHYVIAKIKNIYEDVDAKRFMDRYKKDKTQFLMYHHDPQTFSILEDVMKTYPDKKNPFQAYRLEYGPIRKYSKKGNGPQIQSIKYYDSKLGQHIELKQANQSTKKVVLQSLNPWRCDIYYNKKDKRYIAAGLKYADLSYQKGTGLYGISLQRYQQILNSEKIELSIEQIELLLEGRLNESNFEFCFSLYKNDFIQWNDENNQTFQYRFLARNLSSPNRIEVKPINKSKYDKQAEGLKTLKKGLNRFYKISVDVLGYQHFIKKEKLKLTFK

SEQ ID NO: 117 - protein, 1064 aa, Bacillus niameyensis
MEKLRRVLGLDIGVSSVGWGIIDQDSGDVIDAGVRLFEEAARNANEDRRSFRSSRRLKRRRTHRLERAKSLFEYNGLPSESIGKMDPYQARYNAIFGEVSKEELVAGLYHLVKRRGTTLDSPEDEKSSGNELSTKEQLSRNRKFLENRYICEVQLERLSNGHEKIRNHENRFRTEDYVKEARAILIRQQQRYSEITDEFIEDFINILKSKREYFDGPGSEKSPTPYGQYYLDKDGKLAYTSMINKMRGICTYFPDHLRIAKMSYTADLYNLLSGDLNKLLINGEYLTYEDKLYLIDHFIKKGKNITLTQILKYKGISDDSDVSGYRIDLKTDKPIFTEFTGFKELKKIVDKNDLPSSILEDIDLIDDIIEILTAEKSYYRREEQLKPLFSEYDQETIDRIVNAFKESTSFKGYHALSKKAIELILEDLWYTNKNQMELFAERKLEEKRLSDLKTQTKVMFDGDAILSTVAKRAHREAIKIVNEVRKRYGEMDAIVIETAREKNSEEKRKQYSDFQREIGKHEKEMAKLLGVKSLKDLRLNSKQHLALKLWVSQDRKCIYSGRSISINDIVQDPSKFEIDHILPVSLSFDDSQANKVLCYHRENQKKGQKTPFQYFSTGQASRSFDQFKVEVLNLYKSRKINNKKKDYLLEIRDIAHNEELQKEFINRNLVDTQYAMRSFSMSLRTFFNSHNIDTKVLSIRGSFTAAFRRRARLNKDREESHAHHAIDALIVAAIGRMPIFEFLKEFDMSEEGVVVNRETGEILEENEFFKHKYLSFIRNLMNYESKVKYSHKVDRKVNRTMSNQTIYGTREKDGDTYYLGKVSNIYNLDKHGVEPLLKRLEKSPNSFLIAEHNPKLFELIQLIVKEYKNADNPFKAYYNDHGYVMKDGKVPVKTLRYRDRKLGVHMKITDKYPGAKSDVVLLSIKGVRVDLYKNAEGKYKYLGVPYHWFKQQGNKYVLDMEKYNEEKMKDYKKIDDTFEFQMSLYKNDLFSFERKEGSYFRIFRGDAMPRDNKIEVDFIDKKKQDRKDGFLSPSTFKNIVKYNVDVLGNTYKVEKENFKNTLQL

SEQ ID NO: 118 - protein, 1063 aa, Massilibacterium senegalense
MLENYILGLDIGIGSVGYGLIDENQNIIDAGVRLFPEADVNNNNGRREKRGARRLKRRKQHRVARVKHLLVKNRIMAEDAQPISNKPYEIRVKGLSKELTDEELAIALIHIAKRRGIHNVETTLDEQKDDNELSTKEQISKNEKLLRNKFVCELQLQRLTRNKENEIPYKVRGYQNRFKTSDYIKEVQQILNTQRQYNKKITDEFIERYIELIKKRREYFEGPGEGSEYGWGGDPRKWYEQLMGKCSYFPEELRAVKASYSAQLFNALNDLNNIVIMREENTKLSAEEKRRLIEKVFKIRKKPTLKQIAKEVGVNFEDIKGYRVNAKGEPIFTSFDFYHSIKTITQRHEIIENDKILDQMARILTVMQTPSEKRERLKQEIPELTTSEISEISELRFTSTHSLSLKLIYLLLPELWSTTKNHMQILSEMKLKPKRISLKGRNQIPVSIVDEWILSPVVKRAFTQSIRIVNAIIKRYGEPSEIVIELARERNSEDRKKFLSKLNRKNAAMNEEVKEKIEQLGVYDTKGLFEMIKLWHLQDGHCMYSLTPIPLNDLFLNPNHYEIDHIIPRSISFDDSINNKVLVKYIENQKKGNLTPYQYMNRKIDGVSYDKFKQHVLQLAKSSDKMSRKKREYLLEERDINKFEVQKEFINRNLVDTRYVTRELMNLLKTFFSENNKNVKIKSINGSFTHYLRKLWRFKKDRNIDYKHHAEDALIIAMAGYLFSKKEVLAKQNLILSDPHIVNKETGEILSEDDFTKTFIDKYEKVATIKKYQNYKYSHRVDQKPNRQLMNDTICSTRTVDNNEYVIKKIKDIYAKDNTDLVNKIRKSPKKLLMYHNDRQTYEKIKSIMEQYGDAKNPLYKYKEETGEFVTKYSKKDNGPPILSVKYYSGKLGEHKDITHKFHNSKKRVVNLSIKPFRMDVYKEDGIYKFVTVRFNDLKEKGDNYEICKKIYEEKLKKKKINNKSNFLFSLNKYDIFELDNEEFLFIGVNHDKTNRIECNWINQNYKNFAELNNLKNKQLRKSISKNIIQFEKFATDVLGNRYKVTNEKLIFSYPKKSMRGVR

SEQ ID NO: 119 - protein, 1309 aa, Kurthia huakuii
MNYSIGLDIGTTSVGWACINEQHEILRYQNKWAIGVREFEAAQTAETTRQKRQTRRRYNRRKKRIQLVQQLFSAYVPTDFFGATDSLHFWKNDNQFEQRTLSQVLKELRINPKKIPTIYHLRKLLMEGPKQDIRLIYLAIHNLIKYRGHFLNTGRWTKQNQGFNFLVECSDIVTAYSEINGLALPSLDFQAIQSIIEDTDMVRKDKQKQLEKVSSKSFVPLWQLLLGLSVNAEKLFVESQNTILYKEAKLKLVLGSEELDEVRENLTEVENHFIDEAFALYQQIMLQDLLQGHECVAASKVASYEKYQEDLCEFKRLINETKDEALYRRLFITPKKAMAEYKEQPNKDNKEKLCLLDRYNRSSKDKEAVLNTMAKLLATSNVNHHADLIENIKEGTFLAHQKGTHNAAIPNQNSIYEIEQILTNQQSYYSFITDEFINKVIEIASFRIPYYIGPLAKNNQSKFAWLERINNEGHITPATFDSLVNESITAEQFIKRMINKCTYLQEEDVLPKQSLLYQYFEVLNELNSIQIRPANAASHTKYRLPIEAKKCVIEFGFRQYKVMTHKRLIQVLKEQQFEYLIGEDYEVFGTQQEGRFASSLKSYVEFKSLFKNSAVPFDEVMIEQLIEWLTIFNEKTIIKKKIKEQYPKFPDVMIERVLKKNFVGWGNLSKKLLDELILNDGKTVIEKMCDSTLNFREMLTVKNSNLEELIKKNNRSKRQTKKIKYKDVQDLAGSPALKRGIWQAIKVVEELTEIFGEPQHIMLEVAREEGTKQRTQSRLMKFKAVVDGLGKDEKSLKNELNSYLNEPEAKFKDNRFYLYLLQQGKCAYSGKPLDVQHLAQYEIDHIYPQNFVKDDSLDNLVLVEKSRNQQKGGFKMPLEILNAAEGARMRGIWKSWLDKGFMNDKKFHRLCKAAFSELDRDQFIARQLVETRQIIKNVGVLLEERFSETTVHLVKAPIVSKFRKALELPKLRNLNNKHHAMDALLNALLINHAIQQYGENIFAFSFKDKERSSKLAKAAQQKNGFFLFNSFLSEQIKGPRSRKTLSAIAYVEEIYYELPWQTTKKIGNSDEMFFDETLHSPKIKPAKYESNKTNLSVHDSVKSSAVIVVKLMEQTKKQIVEKIDLIQLSVLEDKQWQHLSNDEKALKLASRKYSTKKIIAATWIMKLSKYQKFMWNNQMFYLASMKERHLATQFIVPKELLMAYLQANEQTSVAKLQTIYATIAEEMFKQYPIYREGNMPKKVAEFTKDIQNFEQMTKQVTEIFKATANNATRSDSLGSRLSKVMKAAEIKVVYESITGLKVRKPKELY

SEQ ID NO: 120 - protein, 1375 aa, Streptococcus equinus
MEKSYSIGLDIGTNSVGWSVITDDYKVPAKKMKVLGNTDKKYIKKNLLGALLFDSGETAEATRLKRTARRRYTRRKNRLRYLQEIFGKEMAKVDESFFQRLEESFLTDDDKTFDSHPIFGNKAEEDAYHQEFPTIYHLRKHLADSPEQADLRLVYLALAHMIKFRGHFLIEGQLDAENTDVQKLFNDFVEVYDRTLDDSHLSEITVDASSILTEKFSKSRRLENLIKHYPTEKKNTLFGNLVALALGLQPNFKTSFKLSEDAKLQFSKDTYEEDLEELLGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMRAILRRQGEYYPFLKENQAKIEKILTFRIPYYVGPLARKNSRFAWAKYHSDEPITPWNFDEVVDKEKSAEKFITRMTLNDLYLPEEKVLPKHSHVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGHANRNFMQLINDDSLSFKTIIQEAQVIGDVDDIEAVVHDLPGSPAIKKGILQSVKIVDELVKVMGHNPQNIVIEMARENQITGYGRNKSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKCKFDNLTKAERGGLTETDKAGFIKRQLVETRQITKHVAQILDARFNTKRDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFDIVRKVLSYPQVNIVKKVEEQTVGQNGGLFDNNILAKPEKDDKKKLFPIKNSLSTTSYGGYARATIAYSILIVSESRERKELKLLGLPLLDKVKYEKNPTAYLNGIGIVNIKNIFKLSKYCLLEFKEKSITYHRYMVSNQELKRANQLSLTCKETELIYTYIKSGEDNIQLDGNEKVILSLWNKMIAFMEQTKLIDKKLFVSLKELKDEVNLINILDIASKSIDFTKISAGQKKIVLNDSLSLPIKRWQFKSDEKMLKQLNDATLIHQSVTGLYETRIDLSKLGEE

SEQ ID NO: 121 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 122 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 123 - protein, 1330 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 124 - protein, 1384 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 125 - protein, 1370 aa, Streptococcus ratti
MKKPYSIGLDIGTNSVGWAVITDDYKVPAKKMKVLGNTDKNYIKKNLLGALLFDSGNTAEDRRLKRTARRRYTRRRNRLLYLQDIFSDEMNKVDESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSDNSDDLHQVVQDLAGSPAIKKGILQSVKIVDELVKVMGYEPEQIVVEMARENQTTAKGRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVETRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTGGLTNETIYPRGSFDKLLNRKNTLEASKYGGFGSPTVAYCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 126 - protein, 1345 aa, Listeria monocytogenes
MQLKIIEGMKKMKKPYTIGLDIGTNSVGWAVLTDQYDLVKRKMKIAGDSEKKQIKKNFWGVRLFDEGQTAADRRMTRTARRRIERRRNRISYLQGIFAEEMSKVDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAEAETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQELDIHNLSNYDIDHIVPQSFITDNSIDNLVLTSSAGNREKGDDVPPLEIVRKRKVFWEKLYQGNLMSKRKFDYLTKAERGGLTETDKARFIHRQLVETRQITKNVANILHQRFNYEKDDHGNTMKQVRIVTLKSALVSQFRKQFQLYKVRDINDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEASDGKSLDYIESNREMFAELLAHVSEFAKRYTLAEANLNKINQLFEQNKEGDIKAIARSFVDLMAFNAMGAPASFKFFETTIERKRYNNLKELLSSTIIYQSITGLYESRKRLDD

SEQ ID NO: 127 - protein, 1365 aa, Lactobacillus sp.
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVKLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKQQAESGENVFAWMVRKNPSGNITPYNFDEKVDREASANTFIQRMKTTDTYLIDEDVLPKQSLLYQKYEVLNELNNVRINNEALSTDQKQRLIHEVFERHSSVTIKQVVDNLVAHGDFAQRPEIRGLADEKRFLSSLSTYHQLKEILHGAIDDSTKLHDIENIITWSTVFEDAAIFKTKLAEIDWLDPATIKKLSNIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLYIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDETDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIQELDRIYNFKRMLITHEVHFETADLFDQTIYAAKDSKERGGRMSLIPKKLGYLTGIYGGYQTERGSYVSIIRTFKKGETIYKVVNILTADVSLLSEKEKVSKTLADIYLKELIAKKLSKGKSGKNIASEPFEIVLPRVGKDSLFKNKKYGLFLIESATELHNYQELWLPRNDQLLIKRIQARQIEESKADYELTRMYRNIAWQVDHYFRLYKIRKFAEKLQASVEDFAGLPVYKNETSDGKVEVLASVLKRLNGAADKGRTNPTTVKLQSDFGRTLLTNGIVLEDDSSIVYQSPTGLFKRSVKLVDL

SEQ ID NO: 128 - protein, 1366 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEEDRKFDIREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQTRPEFAALIQQANEKQFEGNDPNNVWENIESILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGKYLYKCYPKLRPYFVYGKFKKFGDNEDIEVGDGRFNFLNRIERLKNVTDPETGEILWSNVAPNETIKQIKKVYNYKFMLVSRETTTRRAELFNQTVYPKNYRGKLIPIKEDRPTDLYGGYSGNTDAYLAIVALEDKKKGKYFKVVGIPTRAAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 129 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 130 - protein, 1396 aa, Lactobacillus sp.
MTKRIDDYILGLDIGTNSCGWAVTDKKNNLLKLRGKTAIGSHLFDEGHTAAERRSFRTTRRRLKRRKWRLGLLEEIFAEPMAKVDPGFFVRLHQSWVSPLDKDRKKYQAIVFPTAKEDQAFYKHYATIYHLRDELMTQDRQFDLREIFLAIHHIVKYRGNFLQDTPVKDFEASKIEVGPILSHINNAFAEKIVEEQDPIELNVANATDIEAVIRGKDAEKTVYKMDKVKKIAKLLTDSTAKEEKNLAKQIANAIMGYKTQFETILGKEIDKSDKAQWEFKLTDGDADDKLDALLPDLDETDQTIIAEIKKLFSAITLSTIVDENKSLSQSMVAKYDKHHQDYKLLKAYIDTLQDRSIAKKLLLAYDLYVNNRHGRLLEAKKTFEDKKKKKALTKDEFYKIVKDNLDDSDLAHEIRQEIAADNFMPKQRTNSNGVIPFQLHQIELDKIIANQSQYYPFLAAENPVEDHRKQAPYKLDELVRFRVPYYVGPMITADQQKKTSGKSFAWMVRKEDGQITPWNFEQKVDRQESANKFIKRMTIKDTYLLGEDVLPANSLLYQRFEVLNELNNIRINGSRISVDLKQQIFNDLFEEKKTVTEKSLTSYLKQNLHLPTVEIKGLADPTKFNSSLASYYHLKSLHVFDKELADPQYQKDFEKIIEYSSIFEDKKIFQDKLHAEFKWLTPEQFKAISTWRLQGWGRLSRKLLVELHDTNGQNIMEQLWDSQKNFMQIVTEPDFKEAIAKENQNVTQANGVEEILADAYTSPANKKAIRQVVKVVADVVKAAGGKKPAQFAIEFTREPDKNPKLSHIRGTKLLKAYQETAGELVDQKLTDSLKEAMTSRKLLKDKYFLYFMQAGRDAYTGQKINIDEVSTNYQIDHILPQSFIKDDSFDNRVLTATPLNAEKSDDVPYKRFANNYVSDLKMTVGEMWKHWQKDGIINKHKLGNLLLDPDRLNKYQKSGFINRQLVETSQIVKLVSVILQNKYPDSEIITVKAGDNSALRQRLNLYKSREVNDYHHAIDAYLSIICGNFLYQVYPKYRPYFVYGKYKKFSQDPDLQKEVIKHFKGFTFMWPLLQKDNSERKAPEKIKENNSDRIVFYKHPDIFDKLRKAYNYKYMLVSRETNTENSGLFDVTIYPRGERDLAKTRKLIPKGNGLDPKIYGGYSGNSGAYMVIVKIEQAKKSIYKVIGVPMRTLASLNQAKKQGNYQGELHKVLEPQIMFDNKGKPKRGVKGFRVIKDHVPFKQVVLDGDKKFMLYSDQYEANAKQLTLSQETMRIVTDNLKKGEDQDQLLVEAYDEILQKVDQYLPLFDMKGFRNGLHKGRDKFIELSTNDKKSTLSNILNGLHDNMVEIKMEYLGIRTPFGRLQSSSGINLSPDAVLIYQSPTGLFEKRVKIADL

SEQ ID NO: 131 - protein, 1395 aa, Treponema putidum
MKKEIKDYFLGLDVGTGSVGWAVTDTDYKLLKANHKDLWGMRCFETAETAEKRRLFRGARRRIERRRKRIKLLQELFSQEIAKIDEDFFQRMEESPFYAEDKTILQENTLFNDRDFTDKTYHKAYPTINHLIKAWIENKVKPDPRLLYLACHNIIKKRGHFLFEGDFDSENQFDTSVQALFEYLREDMELDIDADSKKIKEILKDSALKNSDKQNRLNKLLGLKSSDKQKKALTNLISGNKANFADLYDNPDLKDAEKNSISFSKDDFDALSDELASVLGDSFELLLRAKAVYNCSVLSKVIGDEQYLSFAKVKIYEKHKNDLTKLKEVVKKYFPIEYRNIFGYKQSENNNCNYSRYVGVCKSGSKKKVINKTASQEDFYKFLKDILLKRSDVPEANGILTEIETGTFLPKQISKNNAEIPYQLRKIELEKILTNAEKFFSFLKQKDENGLSHSEKIIMLLTFKIPYYIGPINTSHKQYFPDRSWVIKKENAPQEKITPWNFFDHIDKEKTAEAFITSRTNFCTYLIGESVLPKNSLLYSEYTVLNEINNLQIIIDGKNICDVKLKQKIYEELFKKYKKVTQKQISTFIKHEGICNKTDEVIILGIDKECTSSLKSYIELKNIFGKQVDEISTKNMLEDIIRWATIYDEGEGKTILKTKIKAEYEKYYSDEQIKKILNLKLSGWGRLSRKFLESITSEIPGFIEPVNIITAMRETQNNLMELLSSKFKFNENIKKINSGFEDTDKRFSYNSLVKPLFLSPSVKKMLWQTLKLVKEISHITQAPPKKIFIEMAKGAELEPARTKTRLKILQDLYNSCKNDADAFSSEIQYLLGKIENEDNLRLRSDKLYLYYTQLGKCMYCGKPIEIGHVFDTSKYDIDHIYPQSKIKDDSINNRVLVCSSCNKNKEDKYPLKPEIQLKQKKFWNFLQRNNFISIEKFNRLTRTTPISDDETAKFIARQLVETRQATKVAAKVLEKIFPETNIVYSKAETVSMFRNKFDIIKCREINDFHHAHDAYLNIVVGNVYNTKFTNNPWNFIKEKRDNPKIGDTYNYYKVFDYDVKRNNITAWEKEKTIITVKTMLKRNTPIYTRQAACKKGELFNQTIMKKGLGQHPLKKECPFSNISKYGGYNKVSAAYYTFIEYEEKGNKIRSLETIPLYLEKDIQKSQDGLKGYLTDQLGKKEIKILVPKIKINSLLKINGFPCHITGKTGASFVLRPAVQFCCSNDEVLYFKKIIRFNEIRSQREKMGKTISPYEDLSFRSYIKENLCKKTKNDEIGEKEFYGFLQKKNLEIYDMLLIKHKDTIYSKRPNSTTLDMLIKGRYEFINLKPEDQIRVMLEILKLFCTTREVIDLGLIKGKSEAGVTTLGKKISNLDSCILIYQSITGIFEKRIDLLKI

SEQ ID NO: 132 - protein, 1345 aa, Eubacterium sp.
MGNKLRNVDDYYLGLDIGTESVGWAVTDKYYVIPKFKGNAMWGVHLFDEGETSVKRRGFRSARRRTQRKRERLALLEALFDEEICKKDCTFFRRLHESDLWPEDKSGDDKYAVFADENYTDKDFHKEYPTIYHLRYELIKNKEPHDVKLVFLALHHIIKNRGHFLFDSLSSAEDFNSAYETMCSYLSDNEIQLNCSDIEQFKAILKDRRQGKIEKTKNLASLFGITKKSDPVSYAVMAVLSGSTVKMCDLFGDDELKTVEKNNISFASGYEENEEIYASVLGDRFELVKILKAVYDWAVLADILDGKKYISEAKVAVYEKHKNDLKTLKKYVKTYLPEKYNEIFKISDGKKDNYVAYSGHIKESGKTGELKKTCNSENFCAYLKKTLGKNADLSYKEMFDEIENKTFMPKQVTKSNGVVPMQVNEEELKAILDNAKDYLSFLNSCDENGVSVYDKIIKIFEYRIPYYVGPLNTHTENSWLKRKDGVKIYPWNFDDVVDIDSSAEKFINNLTSKCTYLPECDVIPKCSLLYSKFTVLNEINNLKLNGEDIPVELKQGIYKDLFMTRRKVTVKQIKDYLKARGCYDNNDVLSGIDTTVKSSLKSYFDFKGFESLTFDDKESIIASSVIFGDDKKLLKKRLKKLFPEKLTDEDIKKICKLKYTGWSRLSKEFLCDVEFTYKKTGEVMNVITALWETNYNLMQILYSEDFCCDGDEKKNLNDKLDELSYTGDQHSLRKAVDALYVSPKVKRPILRALLIAKEIEKIQERPPKKIFVEVARGIDNREERHRDSRKNRLMELYKNCKKEAEKFCPYFDALSKKLSDEDESKLRRDKLYFYYIQLGKCMYTGEEISLGELMNGNGRFDIDHIYPRSKIKDDSLTNKVLVNKTVNNNKTNVYPIDAAIQSKMSPYWQMLRSSGLISEETYKRLTRKTPLTDDELSAFVSRQLTETQQSTKAVAHILEQLYPKPKTEIVYVKAALVHAFRQSNDMLKCREVNDLHHAKDAYLNIVVGNAYNVKVTHNKVNFIKGLQNNDKGYTVNPEKFFSHDIPGAWSVKDSMNTVRRFMNKNNIRYTRFPRKKQGGLFKINPLKKGNGQVPLKASGARSCIEKYGGYDKATSAYFSYVEYTDKKGKAVRQMFPVNLYEVKEYEADMQGFVTSRIAEASNVKILIPCVKYDACISFDGCRMFITKKTGNRIGYKPGMQLVLGYKYEKYIRNIENYLTKHKDREIIPRDNISAEENIELYDILTGKMLNTVLSVKFSGIGKKLEKRREKFVLCSPEEQCCVLNEILKILHANVLSGDLSLIGESPNTGTMKTNAKFSEIKDVHSIKLINQSVTGLFEQEIDLLK

SEQ ID NO: 133 - protein, 1239 aa, Bifidobacterium bombi
MSQHRRYRIGIDVGLNSVGLAAVEIDANHDNPLDEIPISILNAQSVIHDGGVDPDEAKSATSRRASAGVARRTRRLHKSKRQRLAKLDEVLNELGYPVEDESQFPAGSNPYIAWQVRAKLAETFIPDVETRKRMISIAIRHIARHRGWRNPYSSVADAERMSHTPSPFMVEYAKKLDFEINDRRTNGFYHSPWQSVDEEGKRLSKSELEKQPKIEDWNDNPINGKTIAQLVVSSLEPQTKIRRDLTHGLQTESTLNIQTEKLHQSDYIHELETIFERQHVDQTTQEQLLEATFHTKNPKAVGAAAKLVGKDALDSRYYRASRATPAFEEYRVMAAIDTLRIREHGTERQLTTDERRKLFDFIKGLPSKKTKNEPSISSLTWGDVADFLGIQRIDLRGLGSLKDGEPVSAKQPPVIETNDIMQKAPDPIAAWWSQANTKERDRFVEFMSNAGAIKDTSDEVRNIDAEISQLLEELTGSELESLDKITLTSGRAAYSSQTLRNITNYMYETGCDLTTARQELYHVGKNWAPPAPPIYEHTGNPSVDRTFSIIHRWLCNMRDQYGEPETVNIEYVRDGFSSTSTQLAEQRERDRRYADNLKMLSNYEGASSRSDVRRIKALQRQNCQCIYCGRTITFETCQMDHVLPRKGPGSDSKFENLVATCGECNKSKSDTLYMNWAKTYPNTNLQDVLRRIQEWSKDGWMTDKRWRQYKEALILRLEATEKQEPLDNRSMESVSYMARELRNRIYGFYGWHDQDDALKQGRQRVFVSSGSMTAAARRTPFESPLIKGADEETYESSLPWLDGMKGKTRLDRRHHAVDASIIAMMRPQIVKILTEAQEIRSEQHDKYRKGQTPDYVCKRRDYWRNWRGTPDTRDEEVFNYWAGEQLRTLTDLVSQKMADDEIPVIYPTRLRLGNGSAHKDTVVSMMTRKVGDELSITAINKAESGALYTALTRDSDFDWKTGLSANPNRRIRVHDKWFEADDTIKFLEPAVEVVLKNNTRARIDPEALDKVHSTLYVPVRGGIAEAGNSIHHVRFYKIPKLNSKGKQTGSIYAMLRVLTIDLAMNQYDKETGKKQDLFTLPLPESSLSRRFSEPKLRQALIDGTAEYLGWAVVDDELEIPAFANARITEEQAINGSFTDRLLHSFPGTHKFRFAGFSRNTEIAIRPVQLASEGLIETDENRKRQQLRLTQPNTEYSNSIKNVLKSGLHLKVNTLFQTGILVTRANSQGKQSIRFSTVEE

SEQ ID NO: 134 - protein, 1095 aa, Corynebacterium camporealensis
MQKNYRVGIDVGTHSIGFAAIEVDDHDRPIHILSAMSLIHDSGLDPDSNKRALTRLAESGVARRTRRLYRRRRKRMVRLEKFLQHQGWETKPFEDYSDPYIPWNARVALVNGYIEDDQQRGEYLSIALRHIANHRGWRNPYWKTRSLYSPEGPSDAFETIRKDLEKRAGRPVPKDITVGQLITFARIGTDRIRGEAQNKKTGHNNPAILSARLHQLDHAREINEIAKVQKLDDDLRKHIIDLVFAAESPKGAQLGRVGKDPLQPGKDRALKATDAFQRYRIAALTGNLRIRGTQGNDRLTREQRQLIFDHLVNLPHTEEPSWLNIAEILGIDRGDLLGTATMTDDGERAGSKPPVHDTNRAILSSKVKPLVHWWKAANFDEQKAMLKSLSNAEVDDFDSPAGASVQAFFADLDEKQHDKLDSLHLPMGRAAYSEDTLVRLTERMLNNNQDLYEARLAEFNIAKDWTPPKPRIGEPVGNPAVDRVLKATARWLEAAHKEWGAPKSIIIEHVRDGFISEAKAREIDRDNNRRAQRNRELFGKMQSKLGIEGKPRSADLWRFQSVQRQNCCCAYCGDTITFQNCEMDHIVPRAGEGSTNTRDNLVAVCHRCNLAKKNIPFAVWAKNANIPGVSLKEALNRTRHWVEDTGMSSKDFQRFVSNVRARLKRTSVDEPLDNRSIESVAWMANELRSRVAQHFGEYGTKVGVYRGELTAEARNAAGIRRKLRFIDGTGKSRLDRRHHAVDAAVICFTQNYVAEVLAKRSSMRRAAQLNREPEQWREFTGSTDAHRAAWNAWVNKMHLLANLLQTALDEDRIVVTSNLRLRLGNGRAHEDTIGELKKIRVGDAISVTDIDRASTEALWCALTRDPDFDPKEGLPENPHRRIRIHGTWYDADDHIEVFPVGAGAIKVRGGYAELSRFHHARVYKITSGKKPTYAMLRVYTTDLTAYRNEDLFSVEIKPQTMSMRQAEPKLRKAIAEGQAEYLGWIVIDDELLIDTSSFNSGQIAEMQAEFGMVRRWRLDGFVSPSKLRLRPLQMSGEGLAPGASAGSRKIVDQPGWRPAVNKLLSAGNVTIIRRNSLGQVRLNSNAHLPTTWKVD

SEQ ID NO: 135 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 136 - protein, 1039 aa, Environmental metagenome
MIYSANSMAQVEGDVKNRMRKYILGIDLGVNSLGAALIDSENQAIVWTGVRIFSGPFEGDYSSGIEESRARQRRTKRQLRRQIDRRRRRLQRVFTLLQRFGLLPSGERRTVLPALDAELRKRYPETETLPYFLRGRALDVKLEPFEIGRCLYHLAQRRGFQGRTAFADPEEKSGGKFGDEMKGLWNEICSSGARTLGEFLARQPAREVRLRGRHTHRLMYEQEFNLIWDAQKQHHPEILTPEHKALLFQALFFQRPLKSVTHLIGDCSLERGEKRAPCWTLQVQRFRVLSAVNNLRVVEPSGKIRPLEPQERELLAAESLRREQLKFSTIRRILKLDKDCRFTVEEGGEDCIPGNATSARIYKVMGDEWLKWPQDRQEALVAILGDTSRYPTDDDLVKELVTALGLPPENATRLCAVALPTGYASISLNAIAKVTPRLEKGMTFAEARRILWPEDFTEKPPLALLPPVCDTDLKRELRNPAVLRALSELRKVVNAVIREFGKPVSIHIELSRDLKRNRKERQQESERMRSRERARSQARTALAPYYGENVPNREIEKYLLWEECGHRCPYTGEVVALSDLFGPYPRFEVEHIIPFDRCLDDSFQNKTLCEINKNREKGKRTPWEAFGHTPEWPSMVERVRAFGNSAKLRRFIIRETEAERLLEEFSSRQLNDARYASRLAARYLGLLYGIQGSDNRRIIVCAGAVTAYLRQEWDLNRILSAQPVKSREDHRHHAVDALAVALATPAQIKALAECASRAPQVGRRRFAPLPDPWPGFRDQARRAILGTLVSHRPQRKLKAALHEDTYYSPPVERDGKLSVRCRKPVNSLSANEINAIVDPTVRETVRKAWEEVGRDSKKLLNNWPLLQTRRGDLVPIKRVRYYKTQQVQPIAAEDPARTRYVIPGGNHHMEIWAVLDRSTGKPIKWASETISVLEAHRRYRQGSPIIQRDHGPDTRFCFSLSEGDLVKTRRSERDSERIWYVRSVKADGRVVMSPATDARKKEDISKSGELWQVSVNPLMRLGAAKVVVTPLGKVIYAHD

SEQ ID NO: 137 - protein, 1354 aa, Environmental metagenome
MSTKKIVGFDLGTNSVGWAVVENSDENAAKIAGAGSRILPLDPKILDAFENGQKLTKNAERRQKRSQRKTLDRYQLRRKYLIESLIIMGCLPEDFTPQNAGRKFKELIEKPDELKNLPDDWYVYMLRSKALKEPVTQIEFGRILYHLNQRRGYKDIGELMEEIEEKDDTKQGKKYDKWIEQVTIYSVEKKSDLKNKKQEYWVILDDGREGTSIIANIESLTGKEIELEIRRRVKKNSEETFEFALPNRNDWQNKLDALDKQISQSGMHVGEFFWNKIKEDRYFRIRQNFVHREKYIEEFDAIWEKQQEFIPALIDETVKQDVIQRIVRNEKERQKWAKKPLKEFIKNYIIYYQRPLKSQKSKKANCRFEPMIKVINQSTGESLSIENKCMPLSSPLYEEFRIWQKLNNLRYKDINNKNYELTNEQKEALFEKLNNGQTLKESSIFKILGLDKNLYSDFNFDQIEGHTVKSKIASVLKDYDSGKIIGNEEFLYKVWHLLYSVNETEYRKNTLIKWFNLTEEDAKRLAKVRFEKKTGSLSSRAVKKLLPLMRAGKYFDEQSLHDSILFRINNIINGEFDPDVTDDIREFFKEYKSIRDFSGMPYWKAATLVYGSHSTGFSDTRYEKPEEIQLIPAGELRNPVVEQVINETLQIARDIWIKYGKPDEIHLEMAREMKMNSNERQKLTKAMRDQQKKNEEYEEILKKEFNILKPSRTDIIRYRLYIDQKQRCLYTGKPIQKTQLFNGETDIDHIIPRQRYFDDSYNNKVLCFRNVNEEKSNMTSYEFMQQKGIDKWEDFTRRVNELYKEGLISKKKKNYLLSDEIPKDFINRQLNETRYITRRVKEELEKISPVVTTVGSITDYLKEDWKLNKVFKEVQLGRFRSIEKKIDKKLIQEIRINGYHDYQIEGWDKRIDHRHHALDAITIACTNRSIIQTLNNLAQLYESSEPIKNKISRHFPVPAPDFRDQVKNTLETMIVSHKSRRRLITKKRAYYKVLDPSTGAYILKKQEKPSPVVRGPLHDEQPLGEIKEYQKIKIKDAIKKLEENKNNLDKFINGTFPIEWQRKKINEKLSIYNNDPKLFLKNLNKDAILNLKGEKLEYITILVRKYVKSRDLNTSITLSQIENIIDRKLKNEIKNHLKQYNNDPKKAFTDEGLMLFNQNRKFPVYKVRCKVDESEVGTLTTREPLERDSENNPKLHIEKGENYGFVIYENKETGKREYETISFYDAISLARMGLSIVEARPGYRHCVLKHNELIYVLRPGEEKKLINWNDYKNLNNRIYRIVKFTNKRLYAVPHQVAENIVLNEEYENFNEFGSNKNCLEIISDDEPKTKISERCIKINADRLGNIKPAPWEND

SEQ ID NO: 138 - protein, 972 aa, Environmental metagenome
MKTLGLDLGIKSVGWALIESDENRENYRILDLGIRLFSSGQAIENGKVVGPPALPRREARSSRRTIRRKRARLIRIKKFLHNYGLIKNIKDLFYNNKITDVWELRALALNEPLSPEDFSRILIHIAKHRGYMMSVDSDDDEIDGDKDGKKDDKKKIKKAIAETERAIKELNYRTYGEYVYKSALDSKKPMRNRGGEYRYFPSNNLLKKEIDIIFKKQFELGNKFATEELKNKYWEIASSIKDSKSFEDMVGACTFFKDEKRAPKNCYSAEKFVLLTSILNTVVIDEDLKEIKIINIKHIDEIINFAENEDGGISYKKLRKFLSIPDTAMFKGISYEKKKKAKGKKETDPEDKVFVNMYGLNALKKICGEKIAKDKGLSLKIMRVLTYFKGVEQRRSKLLEIEELNADMASQLAKLENIKEFVSLSAKAIEILLPYMESGLRYDEAVKTARIDGKIPYEENLKQDLLPALDPKTNIRITNPTVLRTLSEARKVINAVIRKYGKLDRVNIELARDIKTKKERLKAIQTQNKNIESKKQAEQLLKEKDLNNPSPKKDISKKDILKARLYNQQDGISLYSGEPIKLERLTEDGYCQIDHILPRFKSMDNSFNNKVLCLAEENQNKANDIPYDWLSKTGQFDEFKARVLSMKDKLSYQKVKRLLTEKIDAEGFIERDLNDTRYASRTLKKYLETYLKIGEDDNKVKVLAVNGYLTAELRHQWGLEKDRDANDIHHAVDAVVIALANAGIVKKLANYYKEREYRKHPKFTEPLENFRKVLNEKLVNLPVNRLLVSRPPRKKVTGQAHKETVISPKNKDHSMIEIHKGRGYAEQSLMPRVDVFKKGGKFYYVPIYVADFAKKELPNKIITIGKEKNEWNVADDSYEFLFSLFKDDLIKFKQKGKAEVMGYFLNIGISNCQITYQNINGSKEKNSKGKEFDPYFGGTTLEYIKKYQIDPLGFYYEIKKERRLPVSMKKNN

SEQ ID NO: 139 - protein, 1046 aa, Environmental metagenome
MKYSLGLDIGITSVGWAVLNLDKKRVEALGVRGFNAAEDPKTWASLALPRRLARSARRRLRRRAGRLRRARDLFIKYELIQAQEIKSAFETVLGQPSPWELRAEGLDRLLTGQEFARALFHIIKRRGFKSNRKAAKSSEDGKMIAGIEANRERMREKGFRTAGEMYWSDPFFDLRKRNTTDSYINTVDRGLLEEEIKTLFKRQRELGSVFTKHEFENAILEVFSWQKPYVSGDDIIRMVGTCTFEPNELRAPRYSYHAERFLLLQKINSTTYSTNGDKERFTPEQRKVIEGLAYKNVRVTYAQIRKALDLPEEARFAGLTYLRRPEKKAELVESLECENTVFFELKGYHSIQNACSVDGMWDRVKQNPELMDNLATALTFYKTDEDIEEWLTERGVEKEIINAVSGCEFTKTANLSLVAIKKILPHLEEGLHYSEACAKAGYNHTGLSGEKKKDKLPSIPVDMIRNPVVLRALSQARKVVNAVINRYGSPYAIHIEFARDMGKSADKRKEEERRQRENLKEREELEEQFRETFDGREPNGTDMLKWRLYREQRGCCAYSLQPIDLNRLCEPGYVEVDHILPYSRSFDNSRANKVLVLISENRNKLNRTPYEYFGHNEKRWSEYEGWVRTTIRDPRKRGNLLRESFEERQEVEWKDRNLNDTRYVAREFAGFIRANLLFADPDNKLPLVCINGQVVAQARWLWGLYKDRDENDLHHAQDAAVIAALLPYQIKMITEYSKVVETRRNHIDPETGEIIEWKENERPRLPEPWKGFRKEGVEKLGSILVSRMPQRKVSGAIHADTIRSAKHISTDRVSVVKKPLNSLSENDLKNLFDTEHNKLLYSAIRQRMAEFDNKAQKAFAEPLFKPLRDGSPGPMVRSVKVCQAQYTGVNVRGGIADNGDMVRTDVFRKQNKKGKWEYYLIPVYTVDMISGKLPDKAIAAHKPYNEWPVIDNEYEFLFTLYPYDLIRVETKDGGGLYYYRSSHRANGSLIVCNVNKADTTFGIGSRTAISIEKLEMGVLGDYFPVHKEIRRGLENGSHLEPDKIES

SEQ ID NO: 140 - protein, 1094 aa, Environmental metagenome
MTVRYRLGLDLGTNSIGWAAVALDAEGRPGRLLDGGVRIITPNDEAGRDPKSKASLAAGRRAARAMRRRRDRFLRRQKRLMEILTANGLMPADTAARKELEKLDPYWLRARALAEPLTLHEIGRALFHLNQRRGFSSNRITDADDAEGGAMKQGMAQLQEALEQAGARTLGEFLAKRHRRDREGYRVDPSGQRISKANGNDREASKGVRFRPHAEGSKLLYDFYPTRDMVAHELRQVWVEQAKTHTELTEPLREQLEHVIIAQRPLKKPRVGRCTFRPDEERAPRALPLFQRFRILSELAALEIERPGRPARKLTIPERDLLANLLGSQTSPVSFTKMAKALKLPDDADFNLARGGRKGLDPDKTAAILAKTGKGESFGKGWRSIPFDRQSEIVQRLLNEPDEDALISFLIEECDLSDEQAQAASSARLPQGHGHIGPSMLEELVDVLQNDSVEVVDPQTGEILPRPLTYDQAVVRLGSHHSHFTGERRERLPYYGEVLARHVIANPDAPEGSQERIGRVPNPTVHIALNQTAKLVNALIEAHGRPDEIVIELARELKQNRQQKDEAIRQNRSNETERARMREELASLGYADTPGNMLLLRLYFELPPDERVCVYSGEPISKEMLFSGAVDIDHILPRSKTLDDGFANKVLCTREMNRRKGNRAPADAWSAEELLIIHERSKRLFPRKAWRFAPDAMEKYAENNDFLARHLTDSQHMARLAKTYLGTLYGEDAAKRVWSTPGRLTAMLRGMWGLNGLLKDHNRAGADGADVKNRDDHRHHFLDAFVVACTDRGTLQRVATASARAEAMEIDRWAEKGAFPEPFEGYREQISDRIGTMVVSHKPDHGITPGRARERQATSGQLHEDTAYGRVDEQVNGKTYNLVTRKPIGALTKNEIGQVRDVRIREALQEVAYEADRDGIKLGEALARFGEENGIRRVRVLKTDKTAIALTHGDGRFHKTYVPGDNHRLEIFVAPDGNWTGEAVTVFDANRKDFTPAWQSMTPRPALIMRLHKGDLLEADFGEGRCIWRVVRLEPSAKRVRLVRDFDAGAYEERHKDAEDPFRWNFASYARLQAAAATRVRVDPIGRVLPAREH

SEQ ID NO: 141 - protein, 1037 aa, Environmental metagenome
MALIFAFDIGTTSIGSAVINHDPGRKIGKILRLGVRIFPETREPKTNAPLNQQRRAKRMMRRQLRRRRARRRTLNEALSSAGLLPAFGTSQWDRLMRLDPYDLRSRGLTEALEPEEFGRAIYHLAQRRHFRGRDIESESEDDNADSEELAARAEAKDMLATLRQSGMTLGQWLNQIESGKRKRGIHAARSTVEDEFERLWAAQEAHNDKLKDPEFQSSIRKIIFYQRPVFWRQNTLGSCPLIPGAELCPKGSWLSMQRRMLEKLNNLELVGAGARKLDPEERMAILESLQSQASMSWAGVRKALSSIYRNRNLTGEEKRLKFNLEIGGEKGLIGNPLEQRIAAIVGKSWSAHPHKQKIREALHERLWKADYRKIGTQRVVIQPQKKRRLDRLNAAESIVKEFELPGDLIQPISEISFPSGWEPYSIDALLRIIPELENGTRFGELLVGPELEDWRTKTFPDRIRPTGQISDRLPSPSDPDENRRLRSIRNPTVVRCQNELRKVVNNLIDVYGKPDIIRVELARDVGRSKRDREEFQRVIRQRETERKAAIRDLETNGIVQPSRSDIEKWLLWKESGQICPYTGDAIGFDDLFRTGRFEVEHIWPRSRCLDDSFANKTLCRSDINKEKGNRTPYEHLGSNTDQWHRMQDRLKGMVRKGKKPGMAFSKTKRFLAKEIPDDFTHRMLNDTSYAARESVNMLKQLWPQGGANMPVTVQVVSGRVTAQLRRLWGLNNLLHDGAEKTRADHRHHAVDALVVASCNPGITQSLSRYWKLRESPSAETHPIPLPWPEIRQDATQALDKVIVSHRVSRKLSGPLHEETHFGDTGLEAVRRGTIYRQYVRRKPLHELSPKELDCIRDPAVQSIVRKWVNARGGDPKKAFSDGYPKLGTNGPEIKKVRLVVEKRPELTIHTGSGVVDKGKNHHLAVYRNEEGKLLFRIVSLNEARTALAELGHPVAKTEASAKLLFSLSAGDCLSIPDGDETKLWIVSSTWAEGRVTISETHDAAGQTKTNPSILALVRKGALKVSVDPIGRVRPARD

SEQ ID NO: 142 - protein, 1525 aa, Environmental metagenome
MTKILGLDLGTNSIGWAVVDKENNKIDNCGVRIFPEGVVNMNEGEEREKSKNALRRENRQTRRQVARRRMRKIKLLELLIEQGMCPLTNEQLMIWKHWDKNKKSEGRHFPHTKEFIEWLRLNPYELRYKGINGELTKMEFGRFLYHIIQRRGFLSTRKEKETGKIYAGKENMVGIDDTKTELNGNTLGEYLYTIYPEENESYKNIQNEEGEDVRIRGRYTLRDMYVEEFEKIWQNQASRLGLDKVSVIKQKVVFLNGSKDRNRNAKKIKYLKNNRDKIEVQEIIVEREKANKTLTRVTSYENIPLHDHLGGNIEISDDKIKFDNKDSVLFYQRPLRSQKSLLGKCRYEKNKTPVSVSHPDYELFRAWQYVNTIKFGNNIPLPIEQKSAIVEFLRTKKTSVKFADIVKLLNMSHENFNYNYDDKVEGCPSIAQLSKLFSNEGWENNYHNIWHDFYFFDDSEKLFKKLANTKEYKMKNVIKIDDIKKVSIKDDKYASLSLKAVRNILPFLQRGLMYNQAVFLGGVMNAFNYKALSDEIARWDRFADYHDTIIKDILSIIKERNKEGEAIQKVKEYLSDPANHYGFEKESPAFKKLYHHSQEIEEKEMSDKLSEIENLRNPIVQRAIQEMRRMINELIEKYGKFDRIAVEMGREMKLSKKGRQNVSRMIHQNFEANENVREILKDYQLAPSRQNIQKVLLFNEIQEKAGKVVCPYSGRTLNISDLLGSENKVQIEHIIPRSFSQDDSFTNKTICDAKFNQLKGNLTPYQFYQQNNNKTLWGAATWEEVEQRAYSVLPFNKAKRFTTRKTEWKTEEFISRQLNDDRYISKKTKEILSEVCNEILVMPGAVTADLRRLWGLNNILQPTIGLPDDEFNIDREKDINYWAVTDENRKIKKLYPMNNLRPDAAAEETVVAGYVTKNKFKAQRLNLEFDAPDISDGKYYVKFHVSKPVKTLRQYVDKPEYGENEIILRGVINRNKFNHDSLKRKIDAPKNIDDGSYWAKFKIVDKRFEEPEKNKRPENKNGICLFGKVKDNVFTSYIYQCETNLEDGHYWVLLDLDFEHVEFVATKNEKPDIENNQLLVLGDLNQEGTFTALHDIQLQFDWNDKPGRYWAVLNILPDIPEFTAVENEPPEIEDDEKLIEGKIWVDHKTGEIRFDPKKNRDDHRHHAVDAITIALTDYNNINQLNWYNAQKDKLEKGIPTERPSFDEPWENFFSDAREAAGKILVSHHKDNTVTKKVTMIIEKNGKKFRSEGQAVRGQLHKETVYGKRTPPRAEQAFHVRKPIESLNDKQLDKIVDDNVRSIVKYGREREKFIKEQIKALQKDRTKAGDEEEKKIDQQIKSLEEENRQLYTLPNKNGDRVPIKKVRIRENLGNTEMLKPSENINQYVNPRNNHHVMIYKDSDGQLKESIVTLWEAAERKNQGNSVYQLPPDGLEVVSTLAVNDMFLLGLETEQNKDIKKLDYQILSKHLYRVQKLSSMYYTFRHHLASTVTNSDEEFSIRSFGTWEKVNPIRVKVNQIGEVIRSL

SEQ ID NO: 143 - protein, 978 aa, Environmental metagenome
MSKMILGLDLGITSIGWALVNVDDEDAQNNKIIDSGVRIFTIAEHPKDGKSLALPRREARGARRTTKRKAQKIKAVKRLLIKEKVVTANELNNLFIGNKKQKDVWDLRREALYRELNNKEFARIMVHLAKHRGYASNRKSEEPTDSEGKAVLSGITHNKTILQEKSYLTIGEYISTKTKKRNGKDTEGKLNYENSVSREMLINEITTIFERQKEFSNPHAKEELLEEYKNIAFTQRALKSVEGMVANCPFETNKKRAPKASSTFETFRALQKLKNLRMISNEGESALTKEQILQAIQKAKTAKSFTYKTLKTLFALPKEVQFKGLTYFDHKTGEAKEPESAKLLDFSAYQKIKDAIQSSDNLYWNKIEESVNLLDEIAKILSTHKDDKKSLEELNKIIDNPSVCNALISLSFSGFGHISVEAMRKINPYLLEGIDYDKACEMAGYDFKAIFKGDKSTLLPPLSEQENLEMTNPVVKRAIAQMRLVYNAITRKYGAIDAVHVEFTRDIKKSHKDRNDIKKSQEEFQALKEEAKAEAIKILGKEPSAKELLKFRLWKEQNGECIYSGAYISPSILADPYATEVDHILPYSRSLDDSLNNKVLCLTKQNQDKGNKTPFEYFGADKDSKEWQEFTGRVEGLKNIKGAKKGRLTKTNFDESSENAFKERNKNDTSYISKFVKNYIESHVEFKESKMKRHVYTMNGMLTSQLRYKWGVGDKNRENHLHHAEDAIILAFATQAQVQKLSTTSAKREGFSFKNKEEKAKELRFEPPMENFNEKVKESIENIFVSHMPRRKVSGSAHKETVYSNKTHSVKKADGKVEYLKGNSVNNNVKLKHGIALNDSMPRVDLFQNKKTNKYYLVPIYVSDFVQETLPNKAIVAGNKPWLEMDEEYEFKFSFYKSDLIEVKTKKTATKESVQVLGYFNTAVSSTAQVVIDTHDGNEEYRYGTQNLIFVKKYQVDALGNYIEVKNEKRQGTKKQNR

SEQ ID NO: 144 - protein, 1037 aa, Environmental metagenome
MFGKMRYRLALDLGSTSLGWAMVRLDKENQPCAVIKAGARIFSDGRNPKDGSSLAVTRRAARAMRRRRDRLLKRKQRMMDALIKHGFFPATAAERKALETLNPYALRAKGLDKALTPAEFARALFHINQRRGFKSNRKTDKKENDSGALKTAIQKLRESLQGENCRTVGEWLNKRDNSGQTVRARYRQEKHIKEDGKSKIDKYYDLYIDRAMIEHEFDELWSKQAELDPARFNETARAELKDILLHQRPLKPVKPGRCTFLPEEERAPLALPSTQRFRMYQEVNNLRILRDGLKEEPLTLEQRDTLIFALEENNKCSFTRIKKLLGLSGAVQFNFEDPKRQELKGNTTSAILGKKDLFGPDWFKFDETKQDAIVMKLLTEESEETLVRWLQNETGVDEKTAEAIANAGLPEGYGSLSAQALARILPELRRDVVTYDKAVKAAGFEHHSKLGSDTEIPSITFKTERIDLDTGEIKAFHIHDKLPYYGEYLQRHVGFGSGKPEDTPEKRYGKITNPTVHIGLNQVRLVVNALIQRYGHPSEVIVEVARELKQNHEQRKEESKRQAENQDRNKRLRSNIAGILKISEEQVSRDDIEKMILWEELSHDVADRKCPYSGVPISASMLLSSEVEIEHILPFSQTLDDSLNNKTVSMRQANRIKGNRTPWEAKQDFEAQGWKFDDILARAGNMKKEKRYRFAEDGYKRWLKDDAGFLPRALNDTRHLSKVAREYLTLICPQATRVIPGRMTAMLRGKFGLNDVLGLNGEKNRNDHRHHAVDACVIAVTDQGLLQRFAKASASAREKQLNRLVESMPLPWENYREHVQRAVGNILVSHKPDHSHEGAMHNDTAYGLRDGGKVSFHKMVDGKRERTEESLKVIKISDAKAIERHGVLPTGEPKPYKGYKGDSNYCIEIVRNEKGKWEGEVISTFDAYQLVRQHGIERLRHPSLSVSGKPLAMRLMKNDCVKLQLDNEIITSRVCWVRTDTRIAFAPVSEANVDARDRDKGDQFSYIIKTASVLQKLCARQITITPIGELHDPGFKV

SEQ ID NO: 145 - protein, 1028 aa, Environmental metagenome
MRIWGFDVGTTSIGFAVIDYDSDRKAGRIERLGVRIFPEGVTEDKGEPRNAQRRAKRMMRRQLRRKRWRRRALHEILAEAGLLPTDDPKQWPAELAQADPYDLRDRGLSQKLSPHEVGRALFHILKRRGFQSARIAAVEPSDPAKEKEDEGIKAEISQIAAELQGRTLGQWLKSQSKRRGHHTARTMTQEEFERFWTAQVKYHPDLLTDNLRAALAETAFRQRPIFWRLKTLGTCLLEKDAPLCPKGAWIGQRFEMLQTLNNLRLAGGNARPLDEDERRLLLAALETSPSLSFPAARKLLKPVWQRNGTSLKTKFNFEVEGGKKALPGNALEAALIDAFGEAWNTHPKKDAIRAELQDRLWAIQYRKLGEKRVEIRDGNSAEAERQRFIAFAQAEWNASRKTAETLSRIEPPAAWLRHSIKAIQKLLPHMEAGLTYAEARKLVYPEQFEKSDPIEKLPSDPRQFEDLRNPTVKRALTELRKVVNNLLATYGKPERIRIELARNVALTGKDKANYMRTLAERERQRKQAAKELKASLGREPTAGDIEKWLLWQECEKTCPYTFDSIGFADLFGNMPRYDIEHIWPRSLSLDDSFANKTLCRRDVNNKKGQRTPFELYASNHGIADLPDWEEVKIHLRNKVDAGHFPESKWKRFTREQPFAAADDRSDDRLIGDTAYIAREARAWLGQLMPRGIFDVEPRNGRIVSRLRKLWHLDRLLGEDGRKNRDDHRHHALDAAVTALFDTRAMQDIVRWYKAQEDRPEEKPPAIDLPWPAFRDDLRTALEAIVVSHRVRRKVNGPLHDETRLGDSGEPPIREGGKEYRFYVKRKALAQMSKGEIDAIRDERIRTLAQERLAAHDGDVKKAFATPLMLPGRAGKPDREVKKARVIVKSQPHLVTALNGGKAYAAASDNHHMAIYRSIDGKVSYRTVSRIEAARRTARKEPVVQRVLPDGAQLLFTLTPGTTLAFPNNNGRPIYRVVTSVWDSGQIVLVDHTEAGGTVWKRPNASSLVAMGAKKVSVDPIGRVRPARD

SEQ ID NO: 146 - protein, 1008 aa, Environmental metagenome
MLGLDIGTNSIGWALIDTDPTTGRAVGIRDCGVRIFQEAVDAKTRTPKNAARRSARLLRRLLARRARRKRKLMNLLIKYGLLPPEIAADDAKPEIILNALGDPYELRTKALDEPLQPYELGRVLLHLCARRGFLSNRKAHLVAYLAEEFSDYLAQIDDTDDAANSSASTEDLGKVKDGIKKLSEEIHVSGCRTLGEYLYRLDRHTRKRARFTSRQMYLDEFEMIWESQARYNPILTDDLKIQVHQVIFFQRPLKSQKSLVGKCLLEPGRKRTAKARLEAQQFRIWQDINHIEIQNPETRAWRRLTQEERQKLFHALHEKKSLSWSGVRKLLGIHRGERINLEEAKDKLIGNLTWIELSEALGDRWSRMSDTERQSLVEDLLTISDLTARARRLREHWKLSREEQYLLCTWEPQPGYTNHSLKAIRAMLPYLERGAIYSEARQAAGYKYEVLQLNKPLLGEPPYVRNPVAQKALYQVRRVVNAVIRRYGKPAQIIVELAREMKLSKKQKKALNKQNKRNREANQEAAEQVIRITGVEHPSYDDKLKYRLWKECGGVCPYTGKAISLHELFSDAVDIEHILPYHRTLDDSYMNKTICWADFNRNVKRNQTPWEVLGGDADAWGQLLQRIRSWPKAKRDRMERRSLDGIEDFINRQLNDTRLICRETLGYLKELGVEVCVSRGALTADLRHHWGLNALLSSSEDEKERRDHRHHAVDALVIALTTRRLLQTLSELSSKQGSRSLKDRLRVGLPWPSFREDAKLAIEKIVVSHAAARKIAGALHEETAYGCRKDGRYVYRKPLNGLFKREHAKDIVDPQIKKIVLEHLDRHGNDPKKAFIPENLPLLKDGAGFRPIKKVRVFAKHRPTSVFAVRDRHGRDFKFLKYGSNHHLEILENPSTGKREMRFVTTMEAAVRARRKNVPVYDRSAPAGWRFLMSLGINDMVEVNQDGGTDYYRVQKLDGGNRRFYLRHHASATTEAREEGLVVSTKSLPLIVRKLSVDPIGQISTAND

SEQ ID NO: 147 - protein, 1399 aa, Environmental metagenome
MKKILGLDLGTNSIGWAYVNEAENTNEQSSIIKLGVRVIPLTTDEQTNFEKGKPITTNASRTLARSARRNLQRYKLRRENLIQILKDNNWITDHTVLTENGNKSTFETFKLRSEAAERALELNELARVLLHINKKRGYKSSRKVNNTEEGQLIDGMDIAKKLYHENITPGEFVLELLKSGKKKIPDFYRSDLNNEFEKIWNNQAKYHPDIFTNSLKDELKGKGKQATWAILKDPLKLVGVKRDKKRDEIKLENYQWRVDALTQQLNFEQIAVVLQEINGQINNSSGYLGAISDRSKELYFNNQTVGQYLYSQLKANPHTRLKNQVFYRQDYMDEFEKIWEVQSKGREHIFTDTLKCEIRDVIIFYQRKLKSQKGLISFCEFEQKEISVGDKKKIVGLRVAPKSSPLFQEFKIWQNLHNVKIKNKNTKEVLVLNQDEKNCLFSELNVKGKLTANQVLKLIKGNPKDWEINYTELDGNRTNQALFDAYLSILEIEGYDVREELKLKLNKDDITLADIDKPAAEIMHMVETIFKHLKIDTNILHFNPLIEGNSFEKQASYQLWHLLYSYEEDNSPTGMETLYRLLGEKFGFNKEQAKIIANVSFQDDYGSLSSKAIRKIFPYIKESDFSTSCELAGYNHSKNSLTKEEIEKRELKTRLEILPKNSLRNPVVEKILNQMINVVNTIIDTENDKLEQDGKIRNFQFDEIRIELARELKKNAKEREDLSKAINTGKIEHDRIIKILQNEDGIKFPTRNDIIRYKLYQELKNNSYKDLYTNTYIERKDLFTNKYDIEHIIPQSRLFDDSFSNKTIVPRQVNLEKGNRTAYDYILEVKGEKAAEEYTQRIEHMYTQKEDGISKAKYKKLLMKESEIGSGFIERDLRDSQYIAKKAKEILFQITKSVVSTSGSITDRLRQDWGLIDVMKELNLPKYEKAGLVEIQHDKNGQPKKVIKNWTKRNDHRHHAMDALTVAFTKHSHIQYLNNLNARKNEDSEKKANIYAIEEKETVKINDGKGNSKRIFKEPILNFRDEAKKHLECVLVSHKAKNKVVTRNINKIKGSDKKQIALTPRGQMHKETVYGRIKQYNSKIEKVSAKFDEDTIAMVSNPQYRSLLLQRLKENGNDPKKAFTGKNALDKAPILLKNGTPLPDKVKLIWLEDNFTIRKEINPDLKIDKVIDEGIKRILQKRLDEFKGDPKKAFADLENNPIWLNKEKGIAIKRVTISGVKNAEALHTAKDHLGNKRLDKNGQEIPVDFVSTGNNHHVAIYEDEKGNLHEKVVSFYEAVARVNQGLPIIDKSYNKDLGWKFLFTMKQNEMFVFPSNDFNPKEIDLLDKKNQALISKYLFRVQKFSEKDYNFRHHLETQIIDTPQLNNIIAIRKRNPNSLKGVIKIRINHVGDIIQIGEY

SEQ ID NO: 148 - protein, 1124 aa, Environmental metagenome
MDSKKILGLDLGTNSIGWSLVEINREENQGRILGMGVRIFPEGVENLNQGEKEISKNAARNVNRSARRQIQRRKRRKTDLLKILIQYDMAPQGDFKDQAYWLSPEFLKWVALNPYELRHRAITEKIALKELGRVFYHLAQHRGFQSNARNVSDNDDSTIYKGGNGMTGIDTTASLIENETLGSALYQKLFPAPGQPFKYFPERIRRRYTTRKMYIDEFEKIWEEQSRFHPELTQQLNEEIGGRRREGYKRDGVLFFQRPLRSQKSKIGKCTFHPNKSRRAISAPDFEEFRIWQFINSIRCNGESLVDADRQLVYNLLVSQDRVKFDKLRKHLGKASAAYSFNFDDETSCPNAPTLRFLSSRGIFSQSWFGFKKSKQEEIWHDLYFYDDKELLRKRAQEKWGLSEDAATKFGDYSLKQGFASLSRRAIQNILPFLALGHDYDVAVTLGGIKNALGDQNIVDIYDTDFRIAVEEIVRTNPRGGYINHLKAWLKDNYGFEDKRLEKLYHHSADVNERKLLNRLPYGMEADRQIQQLRNPIVIQALFELRKVINELLERFGPFDEIKIELGRDLKNPKNRRLEIQRQNKRQQQYHEKVIDRLRELGIDETYDNVLKYKLWEECNATCPYTGRPIAVNQLFSNQIQIEHIIPYSRSLDDSFMNKTLCFSDENARKGDRTPYEYYHGVLGSEKWVDVKQRALSLFKNSRDFPNRYKKFERFVLTSTQDLEGFISRQLNDTRYISREAAEYLRQICPKVWVASGQLTARLRHLWGLNSIIDDKSNQKDRSDHRHHAIDALVVAVHTHRDLQLMSRLNRHGISPDSLADAFPFPWPGFRSDAETYVSNILVSHKTNHRVVSTRLTITRSKGKVFRNKSSAARGALHKETVYGKRKLLDGSYKYHVRKSLEDIKEKAQVDKIVDQKIKDLVRNRLRELGVDITMKKYKVPPGAFFSKDENGQILPLIWLPNNRGGKVPVYSVRINEELGNAAQLKSSQNQYVNPRNNHHILIYKSKNGILKEDIISFWVAAERIRQKSPVYQIPADCEEIIAILRKNDMFLIGWDISIPENSTEILSRHLYRVDNLSSLDYVFKHHLTDNDEEKVRIQSFKKWQELNPIKVRISSTGKVIGLV

SEQ ID NO: 149 - protein, 1358 aa, Acidaminococcus_intestini_RyC-MR95; identical to SEQ ID NO: 129

SEQ ID NO: 150 - protein, 1384 aa, Coriobacterium_glomerans_PW2
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 151 - protein, 1380 aa, Eggerthella_sp._YY7918
MNLRHVGNYNIGLDMGTASVGWAAIDEQGELLHFKGKPTWGSRLFDSANTAATARMPRGQRRRYIRRRWRLDLLQKFFSEEMAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKIEEENTQSMLEGENLLIEDLPGSPAIRRSINQAVRIVDEIVGIAGHAPDNIFIEVTREDDTKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETSQSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRMPMEDSGAFWDATIYSPKAGKKGALPVKQGLPVEKYGSYSREQFAYFFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 152 - protein, 1348 aa, Finegoldia_magna_ATCC_29328
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 153 - protein, 1361 aa, Lactobacillus_rhamnosus_LOCK900
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 154 - protein, 1269 aa, Mycoplasma_gallisepticum_CA06
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 155 - protein, 1377 aa, Streptococcus_agalactiae_NEM316
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 156 - protein, 1371 aa, Streptococcus_dysgalactiae_subsp._equisimilis_AC-2713
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 157 - protein, 1371 aa, Streptococcus_gallolyticus_subsp._gallolyticus_ATCC_43143
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 158 - protein, 1136 aa, Streptococcus_gordonii_str._Challis_substr._CH1
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 159 - protein, 1345 aa, Streptococcus_mutans_GS-5]
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 160 - protein, 1127 aa, Streptococcus_salivarius_JIM8777
MSDLVLGLDIGIGSVGVGILNKVTGEIIHKNSRIFPAAQAENNVERRINRQGRRLTRRKKHRRVRLNHLFEESGLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTSSSNKTKYIDEKQLTEEIYNPVAAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTRYASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVSPWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 161 - protein, 1122 aa, Streptococcus_suis_D9
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWDEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 162 - protein, 1122 aa, Streptococcus_thermophilus_LMG_18311
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 163 - protein, 1395 aa, Treponema_denticola_ATCC_35405
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 164 - protein, 1318 aa, Lactobacillus animalis KCTC 3501
MGSNMLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 165 - protein, 1395 aa, Lactobacillus ceti DSM 22408
MSKKYQNTKYYVGLDIGTSSVGWAVTDANYELLKVNGHKTWGSRLFTEAETALERRTHRATRRRLQRRKQRLDLLDELFAEELAKVDPQFLLRLKESQYHMEDKSTDDKYVLFNDQNRTDGEFFTEYPTIYHLRSELMQGKKEDIRAVYLALHHIVKYRGHFLLPGDNYDMQGNLSELIKRLFKFIEETLFIEDLGLTDEIQSKIEEILLTKTKTRLDRQKEIVKLFNTKHQKLDDKQKKLLEAIFKLCLGLKGNMVNIFGDKGEYGIDFTDVEDKKKKVEFSADYDNNINDYVDFFGEYFELLEITKKINDTVIFSEILVDGKGFSESKVISYEKHQQDLRKLKTLLKSLDKTLGYKYGEGLYQKILLDDVKSNYVNYSGNSQKLKKCTKDEFYGFIKSKLNSVTKKEKVSEAQQKEIAQILADMEFGDYLPLQRTTDNGVIPNQLHKKELIEIIEQQTKYHDFFNDVDENGLTIKDKIISLMTFRIPYYVGPLNDYHKVADGTGHAWIEKKKDGKIYPWNFDEMVDTEATAEKFIKNLTNKCTYLKGEDVLPKESKLYSEFMLLNELNNIKIDNQKLDPKLKMKMVSELFMKKNEKITKKKIVDYLRSIGQANGNEMVSGIDREIKSDLKTIHKIQHYYQDASLEMAENIIRWNTIFNDSTSDILKDKITKAYGDVLTPGQIKGLSNLACKDWGKLSEKFLTGIRCDVGEFKNISIIQAMRDTNNNLMELLSNKYEFMDKIQEYNKEYYGDFTFKAEPSIMDDLYVGPGPKRAIWQAVRIVEEIKRIMGHDPEKIFLETTRTNRAPKVKNTKRYDALEKKYESVKEHEYAEVKKEFEIEKNDSLNIKKLFLYFTQLGHCMYSDEKIPYNELFTNRYDIDHIYPRSKTRDNSMDNLVLVKAECNRDKKDNYPIKLKTNIQQKCQVRWAYLRDKKLITEEKYNRLVRKTPLTEDELSQFIARQLVFTSQSVKATAEVFKRLYEDSKICYVKAENVSDFRYGSTRKMSKDDQPQPFIKNRDVNDFHHAKDAYLNIVVGNVYDVKFTQNPTRFIKANKDYSLNYIFRYPVNKKGENVWDPEQSMKIVEKTLKSNDVRVTKLVKPITSPISNETLHKALKCKPGSYLPRKSSKGTPLADVTKYGGYEKIKNAYYSIYKYTYMKKKECMEEFLLVPIPIHLVNNDEELPKYINDKIAERAKKKKLETVECIVKELYQGTLVRINGYDYRIAGSSGKQFELHNGINLIVEPWVEKVLKETDKFVRKSNSKLDKKQQKENTTETLIEKQLNDVFEYLCRKLNQGIFKNNKHTLPAKLLGDSIQKRFEDASIEDEFEVIKELISAIAKNPQNFKTIQKVLDISGSSIPRFNLKLTKNNVDEFIIKNESVTGLFTHEKVIFRK

SEQ ID NO: 166 - protein, 1400 aa, Tissierellia bacterium KA00581
MGKQKFNDYYLGFDIGTNSAGWAVTDLQYKLLRFNKKDMWGSRLFDEAQTSKERRVYRNSRRRLDRRKKRLKLLEELFLDEISKIDNTFFKRLKESNLYNEDKSIKFNYPLFNDKDYTDIDFYNEYKTIYHLRKDLIFEDKKFDIRLVFIALHHILKYRGHFIFEGQSFEEIKSFDSIFTQLSSYFLENFDFNIDVSIKEKLEEIILSDNTKSIKKTEFKKIFSDNKVLSVLNMAIGSKVSLKDVFNNEELKEQKISFSEIDYENEKRDEFYQLLGEDIFLIDLAKKIYDFMVLKKILKNTDSFSASKVALYCEHKKDLDDLKYIFKKYLTKEDYFKFFRSNVEKINYPSYIGLNKIKSKKIIKENKCSISDINKELKNKYLKDIKLEAKDKELFNRIFNKLDEFKFLEKLKSSENSTVPYQVHEIELKKILDNQRKYYPFLNEKIDGKSVYEKIIQLFEFKIPYYIGPLNTDPNVKGKNTWVVRKDENNKTPITPWNFEQKVDMQKSAEEFIKRMTNRCTYLKAEDVIAKNSLLYEEFILLNELNKVTVDNEILHPTLKTEIINELFKTTVKVTKKKFIEFLKKKQAVNDVESITGIGVEFNCKLQGYNTFRKILGKKIENVNVKNFVEKCIELKCLYGSDKKLFENAIGKIYREYNITDEEFNKINRLNFNKWARLSKKFLTEISFEKTDGTKRFESVIEALRSTNYNLMELLSDKFNLQSKIDEINGEDDFSNIDIKEYVDKLYVSPSVKRSIIQTYKIAMEIKKITKKDPKKIFIEMAKDKGEKGKTTEKRKDKIKKLYKNIKDTLSDYCNNLQDLTLQVEKYDDNRLRQKKLFLYFMQMGKSMYTGRCIDLEDLFNNNVYDIDHIYPQSKVKDDSFDNIVLVEKEENHRKSNELLKEEIQSRMNNYWIFLRENKFISKEKYNRLTRKKDFTDEELGDFVARQLVTTRQSTKEIAKFFEKIFEKTTVVYSKASLVSEFREKYDIIKVREVNDAHHAQDAYLNIVVGNVFNTKFTKNYWKFTKDIKRQNEENPNEKKGYNLRKIYESDVFCNDSVAWVYSKENPKYNTINTVKDMVYRKTANITRMLVEGKGQLFNLTIKDKTQLKKNVGNIVANTPISLKNRKLHLNSVEIAKKYGYFDSLNNAYFVLFKYEEKGKEKIGFDSITIAYKERLKKNLDIEKFLENKGYKNSKLIRKIFKNQKVLINGYPYLLKSFNKQSQIKFNNFKILYLNENNLKFAKDAIKFEKNNANVDLKKQKYIVSFLKKKKQNEINETYEECIDRLNDEFDTLFLKLCDIQKSSIYTNYKLQDFSSNKKSIEIKDKFDIFKSLDLYKKSKLIKEFLNYYKYEKNDLDFSLIDIDKKANCIQKHFTEDLVKDFVIVDESVTGLFVKKERLK

SEQ ID NO: 167 - protein, 1398 aa, Veillonella parvula ATCC 17745
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERIQEINAKLTEGQIVNPHDIIDDLALSPAVKRAVWQALRIVDEVAHIKKALPARIFVEVTRSNKNEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETNQSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKRLLEQTGALADATIYKATVAGKAKDGAYIGMKTKSSVFADVSKYGGMTKIKNAYSIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 168 - protein, 1130 aa, Streptococcus gallolyticus
MTNGKILGLDIGIASVGVGIIEAKTGKVVHANSRLFSAANAENNAERRGFRGSRRLNRRKKHRVKRVRDLFEKYEIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQTGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDVKCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMPNVKHYAELKPYDKEKFDNVQELVEALGEADKVGRCIKGLNKSNLSIYKVRTDVLGNKYFVKKEGDKPKLDFKNNKK

SEQ ID NO: 169 - protein, 1054 aa, Staphylococcus pasteuri
MKEKYILGLDLGITSVGYGIINFETKKIIDAGVRLFPEANVDNNEGRRSKRGSRRLKRRRIHRLERVKLLLTEYDLINKEQIPTSNNPYQIRVKGLSEILSKDELAIALLHLAKRRGIHNINVSSEDEDASNELSTKEQINRNNKLLKDKYVCEVQLQRLKEGQIRGEKNRFKTTDILKEIDQLLKVQKDYHNLDIDFINQYKEIVETRREYFEGPGQGSPFGWNGDLKKWYEMLMGHCTYFPQELRSVKYAYSADLFNALNDLNNLIIQRDNSEKLEYHEKYHIIENVFKQKKKPTLKQIAKEIGVNPEDIKGYRITKSGTPQFTEFKLYHDLKSIVFDKSILENEAILDQIAEILTIYQDEQSIKEELNKLPEILNEQDKAEIAKLIGYNGTHRLSLKCIHLINEELWQTSRNQMEIFNYLNIKPNKVDLSEQNKIPKDMVNDFILSPVVKRTFIQSINVINKVIEKYGIPEDIIIELARENNSDDRKKFINNLQKKNEATRKRINEIIGQTGNQNAKRIVEKIRLHDQQEGKCLYSLESIALMDLLNNPQNYEVDHIIPRSVAFDNSIHNKVLVKQIENSKKGNRTPYQYLNSSDAKLSYNQFKQHILNLSKSKDRISKKKKDYLLEERDINKFEVQKEFINRNLVDTRYATRELTSYLKAYFSANNMDVKVKTINGSFTNHLRKVWRFDKYRNHGYKHHAEDALIIANADFLFKENKKLQNTNKILEKPTIENNTKKVTVEKEEDYNNVFETPKLVEDIKQYRDYKFSHRVDKKPNRQLINDTLYSTRMKDEHDYIVQTITDIYGKDNTNLKKQFNKNPEKFLMYQNDPKTFEKLSIIMKQYSDEKNPLAKYYEETGEYLTKYSKKNNGPIVKKIKLLGNKVGNHLDVTNKYENSTKKLVKLSIKNYRFDVYLTEKGYKFVTIAYLNVFKKDNYYYIPKDKYQELKEKKKIKDTDQFIASFYKNDLIKLNGDLYKIIGVNSDDRNIIELDYYDIKYKDYCEINNIKGEPRIKKTIGKKTESIEKFTTDVLGNLYLHSTEKAPQLIFKRGL

SEQ ID NO: 170 - protein, 1337 aa, Enterococcus faecalis OG1RF
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 171 - RNA, 17 nt, Prevotella histicola
guugugauuugcuuuaa

SEQ ID NO: 172 - RNA, 20 nt, Chryseobacterium gallinarum
guugugaagugcuuucaaaa

SEQ ID NO: 173 - RNA, 21 nt, Parabacteroides sp.
guugugauuugcuuucauuuu

SEQ ID NO: 174 - RNA, 16 nt, Capnocytophaga canis
guuguaaauugcuuuc

SEQ ID NO: 175 - RNA, 22 nt, Ornithobacterium rhinotracheale
guugugauuugcuuucaaguuc

SEQ ID NO: 176 - RNA, 16 nt, Weeksella virosa
guugugaauuccuuuc

SEQ ID NO: 177 - RNA, 23 nt, Flavobacterium frigidarium
guugugaauugcuuucaaaauug

SEQ ID NO: 178 - RNA, 19 nt, Rikenellaceae sp.
guugugguuugauguagaa

SEQ ID NO: 179 - RNA, 16 nt, Jejuia pallidilutea
guugugaauugcuuuc

SEQ ID NO: 180 - RNA, 17 nt, Caenispirillum salinarum
guccuguagcccggucc

SEQ ID NO: 181 - RNA, 19 nt, Salinispira pacifica
guuguggcuugaaucagau

SEQ ID NO: 182 - RNA, 18 nt, Sulfitobacter donghicola
guugcggcuggaccucgg

SEQ ID NO: 183 - RNA, 17 nt, Mucispirillum schaedleri
guucuguauugaccaca

SEQ ID NO: 184 - RNA, 19 nt, Mesorhizobium sp.
guugcgauugggccgcgcc

SEQ ID NO: 185 - RNA, 23 nt, Neisseria meningitidis
guuguagcucccauucucauuuc

SEQ ID NO: 186 - RNA, 18 nt, Geobacillus sp.
gucauaguuccccugaga

SEQ ID NO: 187 - RNA, 21 nt, Bacillus okhensis
gucauaucuccaucuaauccg

SEQ ID NO: 188 - RNA, 16 nt, Tistrella mobilis
gccgugguuucccuac

SEQ ID NO: 189 - RNA, 20 nt, Kingella kingae
guuguaguucccuuucucau

SEQ ID NO: 190 - RNA, 15 nt, Clostridium perfringens
guuauaguuccuagu

SEQ ID NO: 191 - RNA, 21 nt, Neisseria sp.
guuguagcuuccucucucauc

SEQ ID NO: 192 - RNA, 16 nt, Campylobacter coli
guuuuagucucuuuuu

SEQ ID NO: 193 - RNA, 19 nt, Sulfurospirillum sp.
guuauagccccccaucuca

SEQ ID NO: 194 - RNA, 16 nt, Dechloromonas denitrificans
guuguagcucccucuc

SEQ ID NO: 195 - RNA, 16 nt, Nitratifractor salsuginis
guuuuaagaccccuca

SEQ ID NO: 196 - RNA, 18 nt, Enterococcus cecorum
guuuuuguacucuuaaug

SEQ ID NO: 197 - RNA, 16 nt, Facklamia hominis
guuuuuguacucucga

SEQ ID NO: 198 - RNA, 16 nt, Streptococcus sinensis
guuuuuguacucucaa

SEQ ID NO: 199 - RNA, 18 nt, eubacterium dolichum
guuuuguuaccauaugga

SEQ ID NO: 200 - RNA, 15 nt, Streptococcus macedonicus
guuuuuguacucuca

SEQ ID NO: 201 - RNA, 17 nt, Turicibacter sp.
guuuuaguacccuuaag

SEQ ID NO: 202 - RNA, 16 nt, Bacillus niameyensis
guuuuggcacucuuuc

SEQ ID NO: 203 - RNA, 17 nt, Massilibacterium senegalense
guuuuaguacucuguua

SEQ ID NO: 204 - RNA, 16 nt, Kurthia huakuii
guuuuagaccaaugua

SEQ ID NO: 205 - RNA, 17 nt, Streptococcus equinus
guuuuagagcuguguug

SEQ ID NO: 206 - RNA, 14 nt, Streptococcus equi
guuuuagaguuaug

SEQ ID NO: 207 - RNA, 18 nt, Enterococcus faecium
guuuuagagcuaugcuga

SEQ ID NO: 208 - RNA, 17 nt, Enterococcus italicus
guuuuagagcuauguug

SEQ ID NO: 209 - RNA, 17 nt, Streptococcus agalactiae
guuuuagagcugugcug

SEQ ID NO: 210 - RNA, 17 nt, Streptococcus ratti
guuuuagagcuguguug

SEQ ID NO: 211 - RNA, 14 nt, Listeria monocytogenes
guuuuagagcuaug

SEQ ID NO: 212 - RNA, 16 nt, Lactobacillus sp.
gucucagguagauguc

SEQ ID NO: 213 - RNA, 16 nt, Pediococcus acidilactici
guuucagaaggauguu

SEQ ID NO: 214 - RNA, 15 nt, Acidaminococcus sp.
guuugagagauaugu

SEQ ID NO: 215 - RNA, 16 nt, Lactobacillus sp.
guuuuaggugguuguu

SEQ ID NO: 216 - RNA, 17 nt, Treponema putidum
guuugagaguaguguaa

SEQ ID NO: 217 - RNA, 17 nt, Eubacterium sp.
guuugagaguaguguaa

SEQ ID NO: 218 - RNA, 14 nt, Bifidobacterium bombi
guuucaaauucaau

SEQ ID NO: 219 - RNA, 16 nt, Corynebacterium camporealensis
gcugggguucaguucc

SEQ ID NO: 220 - RNA, 15 nt, Legionella pneumophila
guuucagugguugga

SEQ ID NO: 221 - RNA, 17 nt, Environmental metagenome
gcucugguuggccggga

SEQ ID NO: 222 - RNA, 15 nt, Environmental metagenome
guugugauuugcuuu

SEQ ID NO: 223 - RNA, 16 nt, Environmental metagenome
guuuucggcaucucuc

SEQ ID NO: 224 - RNA, 16 nt, Environmental metagenome
guuauaguuucccuca

SEQ ID NO: 225 - RNA, 17 nt, Environmental metagenome
guugcgguuggccccug

SEQ ID NO: 226 - RNA, 19 nt, Environmental metagenome
gcugcggacugaggccguu

SEQ ID NO: 227 - RNA, 17 nt, Environmental metagenome
guugugguuugauguaa

SEQ ID NO: 228 - RNA, 17 nt, Environmental metagenome
guuauagcccccuuucu

SEQ ID NO: 229 - RNA, 19 nt, Environmental metagenome
guuccggucagagcacaaa

SEQ ID NO: 230 - RNA, 18 nt, Environmental metagenome
gcugcgguuugcggccaa

SEQ ID NO: 231 - RNA, 18 nt, Environmental metagenome
guuguggauuccgggcag

SEQ ID NO: 232 - RNA, 16 nt, Environmental metagenome
guugugaauugcuuuc

SEQ ID NO: 233 - RNA, 18 nt, Environmental metagenome
guuguggauugauuagaa

SEQ ID NO: 234 - RNA, 17 nt, Acidaminococcus_intestini_RyC-MR95
guuugagagauauguaa

SEQ ID NO: 235 - RNA, 18 nt, Coriobacterium_glomerans_PW2
guuuuggagcagugucgu

SEQ ID NO: 236 - RNA, 17 nt, Eggerthella_sp._YY7918
guuuuggagcaguggaa

SEQ ID NO: 237 - RNA, 18 nt, Finegoldia_magna_ATCC_29328
guuugagaaugauguaau

SEQ ID NO: 238 - RNA, 16 nt, Lactobacillus_rhamnosus_LOCK900
gucucagguagauguc

SEQ ID NO: 239 - RNA, 18 nt, Mycoplasma_gallisepticum_CA06
guuuuagcacuguacaau

SEQ ID NO: 240 - RNA, 17 nt, Streptococcus_agalactiae_NEM316
guuuuagagcugugcug

SEQ ID NO: 241 - RNA, 17 nt, Streptococcus_dysgalactiae_subsp._equisimilis_AC-2713
guuuuagagcuauguug

SEQ ID NO: 242 - RNA, 18 nt, Streptococcus_gallolyticus_subsp._gallolyticus_ATCC_43143
guuuuagagcugugcugu

SEQ ID NO: 243 - RNA, 17 nt, Streptococcus_gordonii_str._Challis_substr._CH1
guuuuuguacucucaag

SEQ ID NO: 244 - RNA, 17 nt, Streptococcus_mutans_GS-5]
guuuuagagcuguguug

SEQ ID NO: 245 - RNA, 16 nt, Streptococcus_salivarius_JIM8777
guuuuuguacucucaa

SEQ ID NO: 246 - RNA, 18 nt, Streptococcus_suis_D9
guuuuuguacucucaaga

SEQ ID NO: 247 - RNA, 15 nt, Streptococcus_thermophilus_LMG_18311
guuuuuguacucuca

SEQ ID NO: 248 - RNA, 17 nt, Treponema_denticola_ATCC_35405
guuugagaguuguguaa

SEQ ID NO: 249 - RNA, 28 nt, Lactobacillus animalis KCTC 3501
guuuuagagcuauguuguuuuguaugac

SEQ ID NO: 250 - RNA, 20 nt, Lactobacillus ceti DSM 22408
guuugagaaguguguuguuc

SEQ ID NO: 251 - RNA, 21 nt, Tissierellia bacterium KA00581
guuugagaguaauguaaucua

SEQ ID NO: 252 - RNA, 21 nt, Veillonella parvula ATCC 17745
guuugagaguaguguaauucu

SEQ ID NO: 253 - RNA, 12 nt, Streptococcus gallolyticus
guuuuagagcug

SEQ ID NO: 254 - RNA, 12 nt, Staphylococcus pasteuri
guuuuaguacac

SEQ ID NO: 255 - RNA, 12 nt, Enterococcus faecalis OG1RF
guuuuagaguca

SEQ ID NO: 256 - RNA, 17 nt, Prevotella histicola
uuaaagcaauucacaau

SEQ ID NO: 257 - RNA, 20 nt, Chryseobacterium gallinarum
uuuugaaagcacuucacaau

SEQ ID NO: 258 - RNA, 20 nt, Parabacteroides sp.
aaaaugaagcaaaucacaau

SEQ ID NO: 259 - RNA, 16 nt, Capnocytophaga canis
gaaagcaauuuacaau

SEQ ID NO: 260 - RNA, 22 nt, Ornithobacterium rhinotracheale
gaacuuaaaagcaaaucacaau

SEQ ID NO: 261 - RNA, 16 nt, Weeksella virosa
gaaaggaauucacaau

SEQ ID NO: 262 - RNA, 22 nt, Flavobacterium frigidarium
caauuuugaagcaauucacaau

SEQ ID NO: 263 - RNA, 19 nt, Rikenellaceae sp.
uucuacaucuuaccacaau

SEQ ID NO: 264 - RNA, 17 nt, Jejuia pallidilutea
gaaagacaauucacaac

SEQ ID NO: 265 - RNA, 19 nt, Caenispirillum salinarum
ggaccggcaccuacaggac

SEQ ID NO: 266 - RNA, 19 nt, Salinispira pacifica
aucugauucuuuccacaau

SEQ ID NO: 267 - RNA, 19 nt, Sulfitobacter donghicola
ccgcggucgagccguuaac

SEQ ID NO: 268 - RNA, 18 nt, Mucispirillum schaedleri
uguggugaauacaguaau

SEQ ID NO: 269 - RNA, 20 nt, Mesorhizobium sp.
ggcguggccucuccguuaac

SEQ ID NO: 270 - RNA, 23 nt, Neisseria meningitidis
gaaaugagaaccguugcuacaau

SEQ ID NO: 271 - RNA, 18 nt, Geobacillus sp.
ucucaggguuacuaugau

SEQ ID NO: 272 - RNA, 21 nt, Bacillus okhensis
cggacaugauguugauaugau

SEQ ID NO: 273 - RNA, 16 nt, Tistrella mobilis
guagggaagccacggu

SEQ ID NO: 274 - RNA, 20 nt, Kingella kingae
augagaaacguugcuacaau

SEQ ID NO: 275 - RNA, 15 nt, Clostridium perfringens
acuaguuacuauaac

SEQ ID NO: 276 - RNA, 21 nt, Neisseria sp.
gaugagagccguugcuacaau

SEQ ID NO: 277 - RNA, 16 nt, Campylobacter coli
aaaaagagacuaaaau

SEQ ID NO: 278 - RNA, 20 nt, Sulfurospirillum sp.
ugagaucuaagggcuauaau

SEQ ID NO: 279 - RNA, 18 nt, Dechloromonas denitrificans
gagagccguugcuacaau

SEQ ID NO: 280 - RNA, 16 nt, Nitratifractor salsuginis
ugaggggucuuaaaau

SEQ ID NO: 281 - RNA, 20 nt, Enterococcus cecorum
cauuaagaaucuacaaaaau

SEQ ID NO: 282 - RNA, 19 nt, Facklamia hominis
ucugagaaucuacaaagau

SEQ ID NO: 283 - RNA, 19 nt, Streptococcus sinensis
uugcagaagcuacaaagau

SEQ ID NO: 284 - RNA, 20 nt, eubacterium dolichum
uuuauaugaucuaacaaaac

SEQ ID NO: 285 - RNA, 15 nt, Streptococcus macedonicus
ugagccuacaaagau

SEQ ID NO: 286 - RNA, 19 nt, Turicibacter sp.
cuuaaggaucuacuaaaau

SEQ ID NO: 287 - RNA, 17 nt, Bacillus niameyensis
ggagaaccugucaaaac

SEQ ID NO: 288 - RNA, 19 nt, Massilibacterium senegalense
uaauagaaucuacuaaaau

SEQ ID NO: 289 - RNA, 19 nt, Kurthia huakuii
uacauugguaaguuaaaau

SEQ ID NO: 290 - RNA, 19 nt, Streptococcus equinus
caacacagcgaguuaaaau

SEQ ID NO: 291 - RNA, 17 nt, Streptococcus equi
cauagcaaaguuaaaau

SEQ ID NO: 292 - RNA, 20 nt, Enterococcus faecium
ucaauauagcaaguuaaaau

SEQ ID NO: 293 - RNA, 19 nt, Enterococcus italicus
caacauagcaaguuaaaau

SEQ ID NO: 294 - RNA, 19 nt, Streptococcus agalactiae
cagcacagcacguuaaaau

SEQ ID NO: 295 - RNA, 19 nt, Streptococcus ratti
caacacagcaaguuaaaau

SEQ ID NO: 296 - RNA, 16 nt, Listeria monocytogenes
cauagcaaguuaaaau

SEQ ID NO: 297 - RNA, 19 nt, Lactobacillus sp.
gacaucuacgaguugagau

SEQ ID NO: 298 - RNA, 18 nt, Pediococcus acidilactici
aacauccugauuugaaau

SEQ ID NO: 299 - RNA, 15 nt, Acidaminococcus sp.
auaucgaguucaaau

SEQ ID NO: 300 - RNA, 19 nt, Lactobacillus sp.
aacaaccagauuuuaaaau

SEQ ID NO: 301 - RNA, 19 nt, Treponema putidum
uuacacuacgaguucaaau

SEQ ID NO: 302 - RNA, 19 nt, Eubacterium sp.
uuacacuacgaguucaaau

SEQ ID NO: 303 - RNA, 14 nt, Bifidobacterium bombi
auugaauuugaaau

SEQ ID NO: 304 - RNA, 16 nt, Corynebacterium camporealensis
ggaacugaaccucagu

SEQ ID NO: 305 - RNA, 16 nt, Legionella pneumophila
uucgauacccugaaau

SEQ ID NO: 306 - RNA, 18 nt, Environmental metagenome
uccuugccguaucagagc

SEQ ID NO: 307 - RNA, 15 nt, Environmental metagenome
gaagcaauucacaau

SEQ ID NO: 308 - RNA, 16 nt, Environmental metagenome
gagagaugucgaaaau

SEQ ID NO: 309 - RNA, 16 nt, Environmental metagenome
ugaagguuacuauaau

SEQ ID NO: 310 - RNA, 18 nt, Environmental metagenome
caggggccacccguuaac

SEQ ID NO: 311 - RNA, 20 nt, Environmental metagenome
agcggccucuauucgcaagc

SEQ ID NO: 312 - RNA, 17 nt, Environmental metagenome
uuacaucuuaucacaau

SEQ ID NO: 313 - RNA, 20 nt, Environmental metagenome
agaaacgaaugggcuauaau

SEQ ID NO: 314 - RNA, 20 nt, Environmental metagenome
uuugugcuuugaacgcuaac

SEQ ID NO: 315 - RNA, 18 nt, Environmental metagenome
uuggcucgcuuaccgcag

SEQ ID NO: 316 - RNA, 19 nt, Environmental metagenome
cugccuugguuuccauaac

SEQ ID NO: 317 - RNA, 16 nt, Environmental metagenome
gaaagcaauucacaau

SEQ ID NO: 318 - RNA, 18 nt, Environmental metagenome
uucuaaucuuuccacaau

SEQ ID NO: 319 - RNA, 19 nt, Acidaminococcus_intestini_RyC-MR95
uuacauaucgaguucaaau

SEQ ID NO: 320 - RNA, 20 nt, Coriobacterium_glomerans_PW2
acagcacugcgagucaaaau

SEQ ID NO: 321 - RNA, 19 nt, Eggerthella_sp._YY7918
uuucacugcgagucaaaau

SEQ ID NO: 322 - RNA, 20 nt, Finegoldia_magna_ATCC_29328
auuacaucaugaguucaaau

SEQ ID NO: 323 - RNA, 19 nt, Lactobacillus_rhamnosus_LOCK900
gacaucuacaaguugagau

SEQ ID NO: 324 - RNA, 19 nt, Mycoplasma_gallisepticum_CA06
auuauugucgugcuaaaau

SEQ ID NO: 325 - RNA, 19 nt, Streptococcus_agalactiae_NEM316
cagcacagcacguuaaaau

SEQ ID NO: 326 - RNA, 19 nt, Streptococcus_dysgalactiae_subsp._equisimilis_AC-2713
caacguagcaaguuaaaau

SEQ ID NO: 327 - RNA, 20 nt, Streptococcus_gallolyticus_subsp._gallolyticus_ATCC_43143
acaacacagcgaguuaaaau

SEQ ID NO: 328 - RNA, 20 nt, Streptococcus_gordonii_str._Challis_substr._CH1
cuugcagaagcuacaaagau

SEQ ID NO: 329 - RNA, 19 nt, Streptococcus_mutans_GS-5]
caacacagcaaguuaaaau

SEQ ID NO: 330 - RNA, 19 nt, Streptococcus_salivarius_JIM8777
uugcagaagcuacaaagau

SEQ ID NO: 331 - RNA, 21 nt, Streptococcus_suis_D9
ucuugcagagccuacaaagau

SEQ ID NO: 332 - RNA, 18 nt, Streptococcus_thermophilus_LMG_18311
ugcagaagcuacaaagau

SEQ ID NO: 333 - RNA, 33 nt, Treponema_denticola_ATCC_35405
uuacacaacgaguucaaauaagaauucaucaaa

SEQ ID NO: 334 - RNA, 21 nt, Lactobacillus animalis KCTC 3501
guuauacaaaacaacauuagc

SEQ ID NO: 335 - RNA, 23 nt, Lactobacillus ceti DSM 22408
gaacaacacacuuaaguucaaau

SEQ ID NO: 336 - RNA, 23 nt, Tissierellia bacterium KA00581
uagauuacauuaugaguucaaau

SEQ ID NO: 337 - RNA, 23 nt, Veillonella parvula ATCC 17745
agaauuacauuacgaguucaaau

SEQ ID NO: 338 - RNA, 14 nt, Streptococcus gallolyticus
cagcgaguuaaaau

SEQ ID NO: 339 - RNA, 14 nt, Staphylococcus pasteuri
gaaucuacugaaac

SEQ ID NO: 340 - RNA, 14 nt, Enterococcus faecalis OG1RF
uagcaaguuaaaau

SEQ ID NO: 341 - RNA, 60 nt, Prevotella histicola
aaggauuauuccgaugugaaaacauuagguugccucguccuaccauacggggcuuuuuuu

SEQ ID NO: 342 - RNA, 56 nt, Chryseobacterium gallinarum
aaggauuauuccguugugaaaacauucaaggcggggcaacucgccuuuuucuuuuu

SEQ ID NO: 343 - RNA, 59 nt, Parabacteroides sp.
aaggauuauuccguugugaaaacauuagguucccucgcccuucugcgggggauuuuuuu

SEQ ID NO: 344 - RNA, 56 nt, Capnocytophaga canis
aaggauuauuccguugugaaaacaucuagugccucgccuaucugcggggcuuuuuu

SEQ ID NO: 345 - RNA, 60 nt, Ornithobacterium rhinotracheale
aaggauuauuccguugugaaaacauuuagugccucgacuaucuucggggcaauuuuuuuu

SEQ ID NO: 346 - RNA, 64 nt, Weeksella virosa
aaggauuauuccguugugaaaacauuuggguugccucuuguccagaaucaggaggcauuuuuuu

SEQ ID NO: 347 - RNA, 56 nt, Flavobacterium frigidarium
aaggauuauuccguugugaaaacauucaaagcggccucacaagggucgcuuuuuuu

SEQ ID NO: 348 - RNA, 61 nt, Rikenellaceae sp.
aaggccaugggccgcagguuuuaauaccuaugucuccgcguacuccguggagacuuuuuuu

SEQ ID NO: 349 - RNA, 61 nt, Jejuia pallidilutea
aaggcuauaagccguagagaaaauucuagcccauugcuuuuguaaugggcauuuuauuuuu

SEQ ID NO: 350 - RNA, 65 nt, Caenispirillum salinarum
aagugaucauacacgugacagccgccucccccgccccaguggccaaggggaggcggcuuuucuuu

SEQ ID NO: 351 - RNA, 59 nt, Salinispira pacifica
aaggcuauacgccgaagugcggaaagcacuauugcccugccuaggcagggcguuuuuuu

SEQ ID NO: 352 - RNA, 54 nt, Sulfitobacter donghicola
aagcauucgauugcaccacauuaaaacgcgggccacggcccgcguuuucuuuuu

SEQ ID NO: 353 - RNA, 53 nt, Mucispirillum schaedleri
aagugaguauucacucacaccaaauuuagccuuucuauauggaaggcuuuuuu

SEQ ID NO: 354 - RNA, 46 nt, Mesorhizobium sp.
aaggcuucaugccaccagauaaaggcgggcuccgguccgccuuuuu

SEQ ID NO: 355 - RNA, 72 nt, Neisseria meningitidis
aaggccgucugaaaagaugugccgcaacgcucugccccuuaaagcuucugcuuuaaggggcaucguuuauuu

SEQ ID NO: 356 - RNA, 62 nt, Geobacillus sp.
aagggcuuucugccuaaggcagacugacccgcggcguuggggaucgccugucgcccgcuuuu

SEQ ID NO: 357 - RNA, 130 nt, Bacillus okhensis
aagacugcuuuuuaagcaguuguggcguuggggaucgccuguucaucuauaaagaugaacuucuccccacuuuauauauuacuauacaccucaguuacuacgaagaucguacguauaacugagguuuuuu

SEQ ID NO: 358 - RNA, 100 nt, Tistrella mobilis
aacagacuuaccguaagguuucucugugaaggaucaucccccauugggcaaccaaugggggaaauuccucaucaauacauugaugagaugcugaauccuu

SEQ ID NO: 359 - RNA, 96 nt, Kingella kingae
aagaaguucugaaaagaaauucguaacgcucugccuccuaaaaauuucgguuuuuagcgggcaucguuuugugaugaauagugcaggcugcuuuuu

SEQ ID NO: 360 - RNA, 61 nt, Clostridium perfringens
aaggcauuaagccguaaaguauccccuauguucauuugaaccuagggguaucuuuucauuu

SEQ ID NO: 361 - RNA, 93 nt, Neisseria sp.
aaggccgucugaaaagacgugccgcgacguaaagauucagaaaugaguugagccccuguuuaaguccgcuuaaacaggggcaucgucuuuauu

SEQ ID NO: 362 - RNA, 83 nt, Campylobacter coli
aagugguuuucgguuagccacgcaggguuacaaucccuuuaaaaccguuaaaauucaaacaaacuagcuugucuaauuuuauu

SEQ ID NO: 363 - RNA, 69 nt, Sulfurospirillum sp.
aaggguuucuaagcuucucccgugaagcgcuacucuacggaguaucuucuaaaaagcuuuuccuuuuuu

SEQ ID NO: 364 - RNA, 100 nt, Dechloromonas denitrificans
aaggugccccuucgggggcgaccgaauccggcccggcagggaaaccugccgggccuuccuuauuccgaccucgguauucgucacuaaucacgcaguugca

SEQ ID NO: 365 - RNA, 94 nt, Nitratifractor salsuginis
caagaacuguuacaacaguuccauucuagggcccaucuucggacgggccucagccucuauuuacuacuucuauuuacagaucagaauuuuucuu

SEQ ID NO: 366 - RNA, 48 nt, Enterococcus cecorum
aagacuuuaugucgaguuucccgucaucauuguauggcggguuuuuuu

SEQ ID NO: 367 - RNA, 49 nt, Facklamia hominis
aaggcuuuaugccgaauuuaccaccugacuuuugaucaggugguuuuuu

SEQ ID NO: 368 - RNA, 47 nt, Streptococcus sinensis
aaggcuucaugccgaaaucaacacccugucucuuggcgggguguuuu

SEQ ID NO: 369 - RNA, 48 nt, eubacterium dolichum
aaggguuuaucccggaaucaaguuccaaguauaugcuuggagcuuuuu

SEQ ID NO: 370 - RNA, 51 nt, Streptococcus macedonicus
aaggcuuuaugccgaauucaagcaccccauguuuugacauggggugcuuuu

SEQ ID NO: 371 - RNA, 42 nt, Turicibacter sp.
aaggcuuuaugccgaaaucagccccucacuggggcuuuuuuu

SEQ ID NO: 372 - RNA, 54 nt, Bacillus niameyensis
aaggguuuaucccgaacucagaaccccauuuuacugggguucuuuucuuuuucu

SEQ ID NO: 373 - RNA, 59 nt, Massilibacterium senegalense
aaggccauagugccguauuugaucuauuaggaucugaccccgcauaugcgggguuuuuu

SEQ ID NO: 374 - RNA, 68 nt, Kurthia huakuii
aagcuuaaagcguaaaaguuggucauauuagaccuccaaccuguagacuauaugucuacagguuuuuu

SEQ ID NO: 375 - RNA, 56 nt, Streptococcus equinus
aaggcuuuguccguacacaacuuguaaaaguggcacccgauucgggugcauuuuuu

SEQ ID NO: 376 - RNA, 54 nt, Streptococcus equi
aaggcuuuguccguaaucaaccugaaaaggggagcaccgaaucggugcuuuuuu

SEQ ID NO: 377 - RNA, 56 nt, Enterococcus faecium
aaggcuuuguccgucaucagcuuuuuuaaagcagcgcuguucucggcgcuuuuuuu

SEQ ID NO: 378 - RNA, 53 nt, Enterococcus italicus
aagguuuaaccguaaucaacuuuuuaguggcgcugucucggcgcuauuuuuuu

SEQ ID NO: 379 - RNA, 67 nt, Streptococcus agalactiae
aaggcagugauuuuuaauccaguccguauucagcuugaaaaagugagcaccgauucggugcuuuuuu

SEQ ID NO: 380 - RNA, 53 nt, Streptococcus ratti
aagguuuauccguauucaacuugaaaaagugcgcaccgauucggugcuuuuuu

SEQ ID NO: 381 - RNA, 68 nt, Listeria monocytogenes
aaggcuuuguccguuaucaacuuuuaauuaaguagcgcuguuucggcgcuuuuuuugugcacuuuuuu

SEQ ID NO: 382 - RNA, 86 nt, Lactobacillus sp.
caaacaaagcuucggcugaguuucaauuucugagcccauguugggccauacauaugccacccgagugcaaaucgggugguuuuuuu

SEQ ID NO: 383 - RNA, 102 nt, Pediococcus acidilactici
caaacaaugcacuuugugcggaguuuauccacuugucccagcuaucugggcaauacauagugaaagaggaaccgacccuuaaugggacggcuccucuuuuuu

SEQ ID NO: 384 - RNA, 78 nt, Acidaminococcus sp.
aacguuuuuacgaagucgccgguucguccggcagcacagugugugcuaugaccugcuuaggcaggucuuuucuuuuuu

SEQ ID NO: 385 - RNA, 80 nt, Lactobacillus sp.
caaacaauguaucuuuuagauacuaaguuucaaugcgguuuauuaccguccugccucagcucuauagcggagguuuuuuu

SEQ ID NO: 386 - RNA, 78 nt, Treponema putidum
aagaauuuaucaaaaucgucccuuuuugggacugcucauuguggagcaucaaggcuuaacauuguuaagccuuuuuuu

SEQ ID NO: 387 - RNA, 79 nt, Eubacterium sp.
aaaaauuuauucuaaccguugcuuuggcaacaucacagugugugaguugagaccugcuuuugcaggucuuuuuauuuuu

SEQ ID NO: 388 - RNA, 67 nt, Bifidobacterium bombi
aaggcuguuccuucguuaguucagucgauugcuccuccgguauugcuuuugcaugccggaguuuuuu

SEQ ID NO: 389 - RNA, 63 nt, Corynebacterium camporealensis
aaucaccggcucguuuccggugaagaaugcuccagucggcgcccacugggcgucgacuuuucu

SEQ ID NO: 390 - RNA, 100 nt, Legionella pneumophila
caacaaaauuaaagauugaaucguuuuucuaugcucgucuuaauagcgagcauauaacgauuucaaaaucuaucguuacagugauuuagaaacucacacu

SEQ ID NO: 391 - RNA, 78 nt, Environmental metagenome
aagguugcguccugccgcgagguaccuggaaacaguagccucugaggacgcccccuguugggggcguuuuuauuuuuu

SEQ ID NO: 392 - RNA, 62 nt, Environmental metagenome
aaggauuauuccguugugaauaacauuuuaagcggcccccaaaaggggucguuucuuuuuuu

SEQ ID NO: 393 - RNA, 51 nt, Environmental metagenome
aaagguuuggggcugaaccugcaaagcacuauccugaaaagguuaucuucu

SEQ ID NO: 394 - RNA, 63 nt, Environmental metagenome
aaggcuaacaaccguaagguaucccccgucagugcccgucauugacggggguauccuuuuuuu

SEQ ID NO: 395 - RNA, 69 nt, Environmental metagenome
aagcaccuugagugcaaaaaauuucuccucuggagaagcguggcgggcugcggcccgccauuugcguuu

SEQ ID NO: 396 - RNA, 84 nt, Environmental metagenome
aauaggacccuuugugugggcucggcaucccaaggucacugccgguauuguucgauucgaagccccgccacggcggggcuuuuu

SEQ ID NO: 397 - RNA, 60 nt, Environmental metagenome
aaggcuauaugccgaaggauguaaauccuauacucccgcuucggugggaguuugguuuuu

SEQ ID NO: 398 - RNA, 69 nt, Environmental metagenome
aaacagguuaugguuccugugcaaggcucugaacacuguucauccuuaaaaaaaccaauuuucuuuuuu

SEQ ID NO: 399 - RNA, 47 nt, Environmental metagenome
aagcaucagaugcaccaaaugcggggccgcuauaugcggccccuuuu

SEQ ID NO: 400 - RNA, 100 nt, Environmental metagenome
gcaaagcuuaagcguuccaagagcgagggcugggcgccccuccgacgcgauauacgcccaacuuucaagcccuugccgguuacgccggcaggggcuuucc

SEQ ID NO: 401 - RNA, 80 nt, Environmental metagenome
aagaaggugaaaccuucgcaggauaucccgaaaggguaaaccgcacgccuccagaucgacagaucugggggcguauuguu

SEQ ID NO: 402 - RNA, 60 nt, Environmental metagenome
aaggauuauuccguugugaaaacauuuagucgccucgucuaucuacggggcauuuuuuuu

SEQ ID NO: 403 - RNA, 57 nt, Environmental metagenome
aaggcuauaggccguaggagaugauuuccuuugcccuugcuucgguaggggcuuuuu

SEQ ID NO: 404 - RNA, 78 nt, Acidaminococcus_intestini_RyC-MR95; identical to SEQ ID NO: 384

SEQ ID NO: 405 - RNA, 78 nt, Coriobacterium_glomerans_PW2
acggcuuugccaaacuugccucccuucggaggcgucucguaggagacaauuugaagccccuuuaggggcuucauuuuu

SEQ ID NO: 406 - RNA, 85 nt, Eggerthella_sp._YY7918
acggcgcuugccaaaaaugcuucggcgccacguagguggcaauuucgacuccaggcaaggaacccuucugggguuucuuguuuuu

SEQ ID NO: 407 - RNA, 70 nt, Finegoldia_magna_ATCC_29328
aaaaguuuacucaaaucgcccgaaagagcccacauugguggacuaaacaaaucuucggauuuguuuuuuu

SEQ ID NO: 408 - RNA, 86 nt, Lactobacillus_rhamnosus_LOCK900
caaacaaagcuucggcugaguuucaauuucugagcccauguugggccauacauaugccacccgagugcaagucggguggcuuuuuu

SEQ ID NO: 409 - RNA, 56 nt, Mycoplasma_gallisepticum_CA06
aaggcgcugcuaaugcagcugccgcauccgccagagcauuuaugcucuggcuuuuu

SEQ ID NO: 410 - RNA, 68 nt, Streptococcus_agalactiae_NEM316
aaggcagugauuuuuaauccaguccguauucagcuugaaaaagugagcaccgauucggugcuuuuuuu

SEQ ID NO: 411 - RNA, 51 nt, Streptococcus_dysgalactiae_subsp._equisimilis_AC-2713
aaggcuaguccguuaucaacuugaaaaaguggcaccgagucggugcuuuuu

SEQ ID NO: 412 - RNA, 57 nt, Streptococcus_gallolyticus_subsp._gallolyticus_ATCC_43143
aaggcuuuguccguacacaacuuguaaaaguggcacccgauucgggugcguuuuuuu

SEQ ID NO: 413 - RNA, 49 nt, Streptococcus_gordonii_str._Challis_substr._CH1
aaggcuucaugccgaauucaacacccugucauuuauggcgggguguuuu

SEQ ID NO: 414 - RNA, 53 nt, Streptococcus_mutans_GS-5]; identical to SEQ ID NO: 380

SEQ ID NO: 415 - RNA, 50 nt, Streptococcus_salivarius_JIM8777
aaggcuucaugccgaaaucaacacccugucauuuuauggcaggguguuuu

SEQ ID NO: 416 - RNA, 48 nt, Streptococcus_suis_D9
aaggcuuuaugccgaaaucaagcaccccguuucguacggggugcuuuu

SEQ ID NO: 417 - RNA, 50 nt, Streptococcus_thermophilus_LMG_18311; identical to SEQ ID NO: 415

SEQ ID NO: 418 - RNA, 64 nt, Treponema_denticola_ATCC_35405
aucgucccuuuugggaccgcucauuguggagcaucaaggcuuaacaugguuaagccuuuuuuuu

SEQ ID NO: 419 - RNA, 76 nt, Lactobacillus animalis KCTC 3501
gaaguuaaaauaagguuuaauccguaaucaacaaguuuuaucuugcgcgcgccguuucggcgcuuuuuuuguuuuu

SEQ ID NO: 420 - RNA, 77 nt, Lactobacillus ceti DSM 22408
aaaaauuuauucuauugaccagaaauggcagcccgcugugggcauuuuaacuucauuuuuuuaaaugaaguuuuuuu

SEQ ID NO: 421 - RNA, 73 nt, Tissierellia bacterium KA00581
aaaaauuuauucaaaccgccaguaauggcuaaccuaaguuguuuaggcaaaacucacuaaggugaguuuuuuu

SEQ ID NO: 422 - RNA, 75 nt, Veillonella parvula ATCC 17745
acaaauuaauuuacaaugccuucgggcugcccgacguagggcaccuacucucaauucuucggaauugaguuuuuu

SEQ ID NO: 423 - RNA, 57 nt, Streptococcus gallolyticus; identical to SEQ ID NO: 412

SEQ ID NO: 424 - RNA, 49 nt, Staphylococcus pasteuri
aagacuauaugucguguuuaucccacuaauuuauuagugggauuuuuuu

SEQ ID NO: 425 - RNA, 52 nt, Enterococcus faecalis OG1RF
aagguuuuaaccguaaucaacuguaaaguggcgcuguuucggcgcuuuuuuu

SEQ ID NO: 426 - RNA, 98 nt, Artificial
  sgRNA solution for Cas9 from ID2 Clade 1
guugugauuugcuuuaagaaauuaaagcaauucacaauaaggauuauuccgaugugaaaacauuagguugccucguccuaccauacggggcuuuuuuu

SEQ ID NO: 427 - RNA, 100 nt, Artificial
  sgRNA solution for Cas9 from ID3 Clade 1
guugugaagugcuuucaaaagaaauuuugaaagcacuucacaauaaggauuauuccguugugaaaacauucaaggcggggcaacucgccuuuuucuuuuu

SEQ ID NO: 428 - RNA, 104 nt, Artificial
  sgRNA solution for Cas9 from ID4 Clade 1
guugugauuugcuuucauuuugaaaaaaaugaagcaaaucacaauaaggauuauuccguugugaaaacauuagguucccucgcccuucugcgggggauuuuuuu

SEQ ID NO: 429 - RNA, 92 nt, Artificial
  sgRNA solution for Cas9 from ID4 Clade 1
guuguaaauugcuuucgaaagaaagcaauuuacaauaaggauuauuccguugugaaaacaucuagugccucgccuaucugcggggcuuuuuu

SEQ ID NO: 430 - RNA, 108 nt, Artificial
  sgRNA solution for Cas9 from ID6 Clade 1
guugugauuugcuuucaaguucgaaagaacuuaaaagcaaaucacaauaaggauuauuccguugugaaaacauuuagugccucgacuaucuucggggcaauuuuuuuu

SEQ ID NO: 431 - RNA, 100 nt, Artificial
  sgRNA solution for Cas9 from ID8 Clade 1
guugugaauuccuuucgaaagaaaggaauucacaauaaggauuauuccguugugaaaacauuuggguugccucuuguccagaaucaggaggcauuuuuuu

SEQ ID NO: 432 - RNA, 105 nt, Artificial
  sgRNA solution for Cas9 from ID9 Clade 1
guugugaauugcuuucaaaauuggaaacaauuuugaagcaauucacaauaaggauuauuccguugugaaaacauucaaagcggccucacaagggucgcuuuuuuu

SEQ ID NO: 433 - RNA, 103 nt, Artificial
  sgRNA solution for Cas9 from ID12 Clade 2
guugugguuugauguagaagaaauucuacaucuuaccacaauaaggccaugggccgcagguuuuaauaccuaugucuccgcguacuccguggagacuuuuuuu

SEQ ID NO: 434 - RNA, 98 nt, Artificial
  sgRNA solution for Cas9 from ID13 Clade 2
guugugaauugcuuucgaaagaaagacaauucacaacaaggcuauaagccguagagaaaauucuagcccauugcuuuuguaaugggcauuuuauuuuu

SEQ ID NO: 435 - RNA, 105 nt, Artificial
  sgRNA solution for Cas9 from ID16 Clade 3
guccuguagcccgguccgaaaggaccggcaccuacaggacaagugaucauacacgugacagccgccucccccgccccaguggccaaggggaggcggcuuuucuuu

SEQ ID NO: 436 - RNA, 101 nt, Artificial
  sgRNA solution for Cas9 from ID17 Clade 3
guuguggcuugaaucagaugaaaaucugauucuuuccacaauaaggcuauacgccgaagugcggaaagcacuauugcccugccuaggcagggcguuuuuuu

SEQ ID NO: 437 - RNA, 95 nt, Artificial
  sgRNA solution for Cas9 from ID18 Clade 3
guugcggcuggaccucgggaaaccgcggucgagccguuaacaagcauucgauugcaccacauuaaaacgcgggccacggcccgcguuuucuuuuu

SEQ ID NO: 438 - RNA, 92 nt, Artificial
  sgRNA solution for Cas9 from ID19 Clade 3
guucuguauugaccacagaaauguggugaauacaguaauaagugaguauucacucacaccaaauuuagccuuucuauauggaaggcuuuuuu

SEQ ID NO: 439 - RNA, 89 nt, Artificial
  sgRNA solution for Cas9 from ID21 Clade 3
guugcgauugggccgcgccgaaaggcguggccucuccguuaacaaggcuucaugccaccagauaaaggcgggcuccgguccgccuuuuu

SEQ ID NO: 440 - RNA, 122 nt, Artificial
  sgRNA solution for Cas9 from ID27 Clade 5
guuguagcucccauucucauuucgaaagaaaugagaaccguugcuacaauaaggccgucugaaaagaugugccgcaacgcucugccccuuaaagcuucugcuuuaaggggcaucguuuauuu

SEQ ID NO: 441 - RNA, 102 nt, Artificial
  sgRNA solution for Cas9 from ID28 Clade 5
gucauaguuccccugagagaaaucucaggguuacuaugauaagggcuuucugccuaaggcagacugacccgcggcguuggggaucgccugucgcccgcuuuu

SEQ ID NO: 442 - RNA, 176 nt, Artificial
  sgRNA solution for Cas9 from ID29 Clade 5
gucauaucuccaucuaauccggaaacggacaugauguugauaugauaagacugcuuuuuaagcaguuguggcguuggggaucgccuguucaucuauaaagaugaacuucuccccacuuuauauauuacuauacaccucaguuacuacgaagaucguacguauaacugagguuuuuu

SEQ ID NO: 443 - RNA, 136 nt, Artificial
  sgRNA solution for Cas9 from ID30 Clade 5
gccgugguuucccuacgaaaguagggaagccacgguaacagacuuaccguaagguuucucugugaaggaucaucccccauugggcaaccaaugggggaaauuccucaucaauacauugaugagaugcugaauccuu

SEQ ID NO: 444 - RNA, 140 nt, Artificial
  sgRNA solution for Cas9 from ID32 Clade 5
guuguaguucccuuucucaugaaaaugagaaacguugcuacaauaagaaguucugaaaagaaauucguaacgcucugccuccuaaaaauuucgguuuuuagcgggcaucguuuugugaugaauagugcaggcugcuuuuu

SEQ ID NO: 445 - RNA, 95 nt, Artificial
  sgRNA solution for Cas9 from ID33 Clade 5
guuauaguuccuagugaaaacuaguuacuauaacaaggcauuaagccguaaaguauccccuauguucauuugaaccuagggguaucuuuucauuu

SEQ ID NO: 446 - RNA, 139 nt, Artificial
  sgRNA solution for Cas9 from ID35 Clade 5
guuguagcuuccucucucaucgaaagaugagagccguugcuacaauaaggccgucugaaaagacgugccgcgacguaaagauucagaaaugaguugagccccuguuuaaguccgcuuaaacaggggcaucgucuuuauu

SEQ ID NO: 447 - RNA, 119 nt, Artificial
  sgRNA solution for Cas9 from ID41 Clade 5
guuuuagucucuuuuugaaaaaaaagagacuaaaauaagugguuuucgguuagccacgcaggguuacaaucccuuuaaaaccguuaaaauucaaacaaacuagcuugucuaauuuuauu

SEQ ID NO: 448 - RNA, 112 nt, Artificial
  sgRNA solution for Cas9 from ID43 Clade 5
guuauagccccccaucucagaaaugagaucuaagggcuauaauaaggguuucuaagcuucucccgugaagcgcuacucuacggaguaucuucuaaaaagcuuuuccuuuuuu

SEQ ID NO: 449 - RNA, 138 nt, Artificial
  sgRNA solution for Cas9 from ID44 Clade 5
guuguagcucccucucgaaagagagccguugcuacaauaaggugccccuucgggggcgaccgaauccggcccggcagggaaaccugccgggccuuccuuauuccgaccucgguauucgucacuaaucacgcaguugca

SEQ ID NO: 450 - RNA, 130 nt, Artificial
  sgRNA solution for Cas9 from ID46 Clade 6
guuuuaagaccccucagaaaugaggggucuuaaaaucaagaacuguuacaacaguuccauucuagggcccaucuucggacgggccucagccucuauuuacuacuucuauuuacagaucagaauuuuucuu

SEQ ID NO: 451 - RNA, 90 nt, Artificial
  sgRNA solution for Cas9 from ID47 Clade 7
guuuuuguacucuuaauggaaacauuaagaaucuacaaaaauaagacuuuaugucgaguuucccgucaucauuguauggcggguuuuuuu

SEQ ID NO: 452 - RNA, 88 nt, Artificial
  sgRNA solution for Cas9 from ID48 Clade 7
guuuuuguacucucgagaaaucugagaaucuacaaagauaaggcuuuaugccgaauuuaccaccugacuuuugaucaggugguuuuuu

SEQ ID NO: 453 - RNA, 86 nt, Artificial
  sgRNA solution for Cas9 from ID50 Clade 7
guuuuuguacucucaagaaauugcagaagcuacaaagauaaggcuucaugccgaaaucaacacccugucucuuggcgggguguuuu

SEQ ID NO: 454 - RNA, 90 nt, Artificial
  sgRNA solution for Cas9 from ID51 Clade 7
guuuuguuaccauauggagaaauuuauaugaucuaacaaaacaaggguuuaucccggaaucaaguuccaaguauaugcuuggagcuuuuu

SEQ ID NO: 455 - RNA, 85 nt, Artificial
  sgRNA solution for Cas9 from ID52 Clade 7
guuuuuguacucucagaaaugagccuacaaagauaaggcuuuaugccgaauucaagcaccccauguuuugacauggggugcuuuu

SEQ ID NO: 456 - RNA, 82 nt, Artificial
  sgRNA solution for Cas9 from ID56 Clade 7
guuuuaguacccuuaaggaaacuuaaggaucuacuaaaauaaggcuuuaugccgaaaucagccccucacuggggcuuuuuuu

SEQ ID NO: 457 - RNA, 91 nt, Artificial
  sgRNA solution for Cas9 from ID60 Clade 7
guuuuggcacucuuucgaaaggagaaccugucaaaacaaggguuuaucccgaacucagaaccccauuuuacugggguucuuuucuuuuucu

SEQ ID NO: 458 - RNA, 99 nt, Artificial
  sgRNA solution for Cas9 from ID61 Clade 7
guuuuaguacucuguuagaaauaauagaaucuacuaaaauaaggccauagugccguauuugaucuauuaggaucugaccccgcauaugcgggguuuuuu

SEQ ID NO: 459 - RNA, 107 nt, Artificial
  sgRNA solution for Cas9 from ID63 Clade 8
guuuuagaccaauguagaaauacauugguaaguuaaaauaagcuuaaagcguaaaaguuggucauauuagaccuccaaccuguagacuauaugucuacagguuuuuu

SEQ ID NO: 460 - RNA, 96 nt, Artificial
  sgRNA solution for Cas9 from ID64 Clade 9
guuuuagagcuguguuggaaacaacacagcgaguuaaaauaaggcuuuguccguacacaacuuguaaaaguggcacccgauucgggugcauuuuuu

SEQ ID NO: 461 - RNA, 89 nt, Artificial
  sgRNA solution for Cas9 from ID65 Clade 9
guuuuagaguuauggaaacauagcaaaguuaaaauaaggcuuuguccguaaucaaccugaaaaggggagcaccgaaucggugcuuuuuu

SEQ ID NO: 462 - RNA, 98 nt, Artificial
  sgRNA solution for Cas9 from ID66 Clade 9
guuuuagagcuaugcugagaaaucaauauagcaaguuaaaauaaggcuuuguccgucaucagcuuuuuuaaagcagcgcuguucucggcgcuuuuuuu

SEQ ID NO: 463 - RNA, 93 nt, Artificial
  sgRNA solution for Cas9 from ID67 Clade 9
guuuuagagcuauguuggaaacaacauagcaaguuaaaauaagguuuaaccguaaucaacuuuuuaguggcgcugucucggcgcuauuuuuuu

SEQ ID NO: 464 - RNA, 107 nt, Artificial
  sgRNA solution for Cas9 from ID68 Clade 9
guuuuagagcugugcuggaaacagcacagcacguuaaaauaaggcagugauuuuuaauccaguccguauucagcuugaaaaagugagcaccgauucggugcuuuuuu

SEQ ID NO: 465 - RNA, 93 nt, Artificial
  sgRNA solution for Cas9 from ID70 Clade 9
guuuuagagcuguguuggaaacaacacagcaaguuaaaauaagguuuauccguauucaacuugaaaaagugcgcaccgauucggugcuuuuuu

SEQ ID NO: 466 - RNA, 102 nt, Artificial
  sgRNA solution for Cas9 from ID71 Clade 9
guuuuagagcuauggaaacauagcaaguuaaaauaaggcuuuguccguuaucaacuuuuaauuaaguagcgcuguuucggcgcuuuuuuugugcacuuuuuu

SEQ ID NO: 467 - RNA, 125 nt, Artificial
  sgRNA solution for Cas9 from ID77 Clade 10
gucucagguagaugucgaaagacaucuacgaguugagaucaaacaaagcuucggcugaguuucaauuucugagcccauguugggccauacauaugccacccgagugcaaaucgggugguuuuuuu

SEQ ID NO: 468 - RNA, 140 nt, Artificial
  sgRNA solution for Cas9 from ID78 Clade 10
guuucagaaggauguugaaaaacauccugauuugaaaucaaacaaugcacuuugugcggaguuuauccacuugucccagcuaucugggcaauacauagugaaagaggaaccgacccuuaaugggacggcuccucuuuuuu

SEQ ID NO: 469 - RNA, 112 nt, Artificial
  sgRNA solution for Cas9 from ID79 Clade 10
guuugagagauaugugaaaauaucgaguucaaauaacguuuuuacgaagucgccgguucguccggcagcacagugugugcuaugaccugcuuaggcaggucuuuucuuuuuu

SEQ ID NO: 470 - RNA, 119 nt, Artificial
  sgRNA solution for Cas9 from ID80 Clade 10
guuuuaggugguuguugaaaaacaaccagauuuuaaaaucaaacaauguaucuuuuagauacuaaguuucaaugcgguuuauuaccguccugccucagcucuauagcggagguuuuuuu

SEQ ID NO: 471 - RNA, 118 nt, Artificial
  sgRNA solution for Cas9 from ID81 Clade 10
guuugagaguaguguaagaaauuacacuacgaguucaaauaagaauuuaucaaaaucgucccuuuuugggacugcucauuguggagcaucaaggcuuaacauuguuaagccuuuuuuu

SEQ ID NO: 472 - RNA, 119 nt, Artificial
  sgRNA solution for Cas9 from ID87 Clade 10
guuugagaguaguguaagaaauuacacuacgaguucaaauaaaaauuuauucuaaccguugcuuuggcaacaucacagugugugaguugagaccugcuuuugcaggucuuuuuauuuuu

SEQ ID NO: 473 - RNA, 99 nt, Artificial
  sgRNA solution for Cas9 from ID94 Clade 11
guuucaaauucaaugaaaauugaauuugaaauaaggcuguuccuucguuaguucagucgauugcuccuccgguauugcuuuugcaugccggaguuuuuu

SEQ ID NO: 474 - RNA, 99 nt, Artificial
  sgRNA solution for Cas9 from ID97 Clade 11
gcugggguucaguuccgaaaggaacugaaccucaguaaucaccggcucguuuccggugaagaaugcuccagucggcgcccacugggcgucgacuuuucu

SEQ ID NO: 475 - RNA, 135 nt, Artificial
  sgRNA solution for Cas9 from ID102 Clade 12
guuucagugguuggagaaauucgauacccugaaaucaacaaaauuaaagauugaaucguuuuucuaugcucgucuuaauagcgagcauauaacgauuucaaaaucuaucguuacagugauuuagaaacucacacu

SEQ ID NO: 476 - RNA, 117 nt, Artificial
  sgRNA solution for Cas9 from ID83 Clade 1
gcucugguuggccgggagaaauccuugccguaucagagcaagguugcguccugccgcgagguaccuggaaacaguagccucugaggacgcccccuguugggggcguuuuuauuuuuu

SEQ ID NO: 477 - RNA, 96 nt, Artificial
  sgRNA solution for Cas9 from ID84 Clade 1
guugugauuugcuuugaaagaagcaauucacaauaaggauuauuccguugugaauaacauuuuaagcggcccccaaaaggggucguuucuuuuuuu

SEQ ID NO: 478 - RNA, 87 nt, Artificial
  sgRNA solution for Cas9 from ID85 Clade 5
guuuucggcaucucucgaaagagagaugucgaaaauaaagguuuggggcugaaccugcaaagcacuauccugaaaagguuaucuucu

SEQ ID NO: 479 - RNA, 99 nt, Artificial
  sgRNA solution for Cas9 from ID88 Clade 5
guuauaguuucccucagaaaugaagguuacuauaauaaggcuaacaaccguaagguaucccccgucagugcccgucauugacggggguauccuuuuuuu

SEQ ID NO: 480 - RNA, 108 nt, Artificial
  sgRNA solution for Cas9 from ID91 Clade 3
guugcgguuggccccuggaaacaggggccacccguuaacaagcaccuugagugcaaaaaauuucuccucuggagaagcguggcgggcugcggcccgccauuugcguuu

SEQ ID NO: 481 - RNA, 127 nt, Artificial
  sgRNA solution for Cas9 from ID93 Clade 3
gcugcggacugaggccguugaaaagcggccucuauucgcaagcaauaggacccuuugugugggcucggcaucccaaggucacugccgguauuguucgauucgaagccccgccacggcggggcuuuuu

SEQ ID NO: 482 - RNA, 98 nt, Artificial
  sgRNA solution for Cas9 from ID139 Clade 3
guugugguuugauguaagaaauuacaucuuaucacaauaaggcuauaugccgaaggauguaaauccuauacucccgcuucggugggaguuugguuuuu

SEQ ID NO: 483 - RNA, 110 nt, Artificial
  sgRNA solution for Cas9 from ID96 Clade 5
guuauagcccccuuucugaaaagaaacgaaugggcuauaauaaacagguuaugguuccugugcaaggcucugaacacuguucauccuuaaaaaaaccaauuuucuuuuuu

SEQ ID NO: 484 - RNA, 90 nt, Artificial
  sgRNA solution for Cas9 from ID98 Clade 3
guuccggucagagcacaaagaaauuugugcuuugaacgcuaacaagcaucagaugcaccaaaugcggggccgcuauaugcggccccuuuu

SEQ ID NO: 485 - RNA, 140 nt, Artificial
  sgRNA solution for Cas9 from ID101 Clade 3
gcugcgguuugcggccaagaaauuggcucgcuuaccgcaggcaaagcuuaagcguuccaagagcgagggcugggcgccccuccgacgcgauauacgcccaacuuucaagcccuugccgguuacgccggcaggggcuuucc

SEQ ID NO: 486 - RNA, 121 nt, Artificial
  sgRNA solution for Cas9 from ID103 Clade 2
guuguggauuccgggcaggaaacugccuugguuuccauaacaagaaggugaaaccuucgcaggauaucccgaaaggguaaaccgcacgccuccagaucgacagaucugggggcguauuguu

SEQ ID NO: 487 - RNA, 96 nt, Artificial
  sgRNA solution for Cas9 from ID104 Clade 1
guugugaauugcuuucgaaagaaagcaauucacaauaaggauuauuccguugugaaaacauuuagucgccucgucuaucuacggggcauuuuuuuu

SEQ ID NO: 488 - RNA, 97 nt, Artificial
  sgRNA solution for Cas9 from ID105 Clade 2
guuguggauugauuagaagaaauucuaaucuuuccacaauaaggcuauaggccguaggagaugauuuccuuugcccuugcuucgguaggggcuuuuu

SEQ ID NO: 489 - RNA, 118 nt, Artificial
  sgRNA solution for Cas9 from ID106 Clade 10
guuugagagauauguaagaaauuacauaucgaguucaaauaacguuuuuacgaagucgccgguucguccggcagcacagugugugcuaugaccugcuuaggcaggucuuuucuuuuuu

SEQ ID NO: 490 - RNA, 120 nt, Artificial
  sgRNA solution for Cas9 from ID107 Clade 8
guuuuggagcagugucgugaaaacagcacugcgagucaaaauacggcuuugccaaacuugccucccuucggaggcgucucguaggagacaauuugaagccccuuuaggggcuucauuuuu

SEQ ID NO: 491 - RNA, 125 nt, Artificial
  sgRNA solution for Cas9 from ID108 Clade 8
guuuuggagcaguggaagaaauuucacugcgagucaaaauacggcgcuugccaaaaaugcuucggcgccacguagguggcaauuucgacuccaggcaaggaacccuucugggguuucuuguuuuu

SEQ ID NO: 492 - RNA, 112 nt, Artificial
  sgRNA solution for Cas9 from ID109 Clade 10
guuugagaaugauguaaugaaaauuacaucaugaguucaaauaaaaguuuacucaaaucgcccgaaagagcccacauugguggacuaaacaaaucuucggauuuguuuuuuu

SEQ ID NO: 493 - RNA, 125 nt, Artificial
  sgRNA solution for Cas9 from ID112 Clade 10
gucucagguagaugucgaaagacaucuacaaguugagaucaaacaaagcuucggcugaguuucaauuucugagcccauguugggccauacauaugccacccgagugcaagucggguggcuuuuuu

SEQ ID NO: 494 - RNA, 97 nt, Artificial
  sgRNA solution for Cas9 from ID116 Clade 7
guuuuagcacuguacaaugaaaauuauugucgugcuaaaauaaggcgcugcuaaugcagcugccgcauccgccagagcauuuaugcucuggcuuuuu

SEQ ID NO: 495 - RNA, 108 nt, Artificial
  sgRNA solution for Cas9 from ID119 Clade 9
guuuuagagcugugcuggaaacagcacagcacguuaaaauaaggcagugauuuuuaauccaguccguauucagcuugaaaaagugagcaccgauucggugcuuuuuuu

SEQ ID NO: 496 - RNA, 91 nt, Artificial
  sgRNA solution for Cas9 from ID120 Clade 9
guuuuagagcuauguuggaaacaacguagcaaguuaaaauaaggcuaguccguuaucaacuugaaaaaguggcaccgagucggugcuuuuu

SEQ ID NO: 497 - RNA, 99 nt, Artificial
  sgRNA solution for Cas9 from ID121 Clade 9
guuuuagagcugugcugugaaaacaacacagcgaguuaaaauaaggcuuuguccguacacaacuuguaaaaguggcacccgauucgggugcguuuuuuu

SEQ ID NO: 498 - RNA, 90 nt, Artificial
  sgRNA solution for Cas9 from ID122 Clade 7
guuuuuguacucucaaggaaacuugcagaagcuacaaagauaaggcuucaugccgaauucaacacccugucauuuauggcgggguguuuu

SEQ ID NO: 499 - RNA, 93 nt, Artificial; identical to SEQ ID NO: 465
  sgRNA solution for Cas9 from ID123 Clade 9

SEQ ID NO: 500 - RNA, 89 nt, Artificial
  sgRNA solution for Cas9 from ID124 Clade 7
guuuuuguacucucaagaaauugcagaagcuacaaagauaaggcuucaugccgaaaucaacacccugucauuuuauggcaggguguuuu

SEQ ID NO: 501 - RNA, 91 nt, Artificial
  sgRNA solution for Cas9 from ID125 Clade 7
guuuuuguacucucaagagaaaucuugcagagccuacaaagauaaggcuuuaugccgaaaucaagcaccccguuucguacggggugcuuuu

SEQ ID NO: 502 - RNA, 87 nt, Artificial
  sgRNA solution for Cas9 from ID126 Clade 7
guuuuuguacucucagaaaugcagaagcuacaaagauaaggcuucaugccgaaaucaacacccugucauuuuauggcaggguguuuu

SEQ ID NO: 503 - RNA, 118 nt, Artificial
  sgRNA solution for Cas9 from ID127 Clade 10
guuugagaguuguguaagaaauuacacaacgaguucaaauaagaauucaucaaaaucgucccuuuugggaccgcucauuguggagcaucaaggcuuaacaugguuaagccuuuuuuuu

SEQ ID NO: 504 - RNA, 129 nt, Artificial
  sgRNA solution for Cas9 from ID131 Clade 9
guuuuagagcuauguuguuuuguaugacgaaaguuauacaaaacaacauuagcgaaguuaaaauaagguuuaauccguaaucaacaaguuuuaucuugcgcgcgccguuucggcgcuuuuuuuguuuuu

SEQ ID NO: 505 - RNA, 124 nt, Artificial
  sgRNA solution for Cas9 from ID132 Clade 10
guuugagaaguguguuguucgaaagaacaacacacuuaaguucaaauaaaaauuuauucuauugaccagaaauggcagcccgcugugggcauuuuaacuucauuuuuuuaaaugaaguuuuuuu

SEQ ID NO: 506 - RNA, 121 nt, Artificial
  sgRNA solution for Cas9 from ID136 Clade 9
guuugagaguaauguaaucuagaaauagauuacauuaugaguucaaauaaaaauuuauucaaaccgccaguaauggcuaaccuaaguuguuuaggcaaaacucacuaaggugaguuuuuuu

SEQ ID NO: 507 - RNA, 123 nt, Artificial
  sgRNA solution for Cas9 from ID138 Clade 10
guuugagaguaguguaauucugaaaagaauuacauuacgaguucaaauacaaauuaauuuacaaugccuucgggcugcccgacguagggcaccuacucucaauucuucggaauugaguuuuuu

SEQ ID NO: 508 - RNA, 87 nt, Artificial
  sgRNA solution for Cas9 ORF from ID141 Clade 7
guuuuagagcuggaaacagcgaguuaaaauaaggcuuuguccguacacaacuuguaaaaguggcacccgauucgggugcguuuuuuu

SEQ ID NO: 509 - RNA, 79 nt, Artificial
  sgRNA solution for Cas9 ORF from ID142 Clade 7
guuuuaguacacgaaagaaucuacugaaacaagacuauaugucguguuuaucccacuaauuuauuagugggauuuuuuu

SEQ ID NO: 510 - RNA, 82 nt, Artificial
  sgRNA solution for Cas9 ORF from ID140 Clade 9
guuuuagagucagaaauagcaaguuaaaauaagguuuuaaccguaaucaacuguaaaguggcgcuguuucggcgcuuuuuuu

SEQ ID NO: 511 - protein, 1068 aa, Bacillus cereus
MKYVLGLDIGIASCGWAVINQEKHRIEDLGVRIFDKAENPKDGKSLATPRRDARSTRRTLRRKKHRMQRIKILLVKHGLLSKTEIDHLYESATEIDVWYLRLNALERRLNPKEFARVLIHLAKRRGFKSNRKETTLSENGQILENISENLQIMEQKNYRTVGEMILKDKRFENHKRNKDGTYIGTVTRQQLQEEIQMIFNAQRLYKNNHATEKFESSYLEIWASQRPYASKDQIEKMIGYCTLEPKEKRVPKASWSFQYFVALQTINNLRLISKDRIEELSFEEKKRIMNLALEKSIVKYIDIRKLLSVPNEFQFNSLSYSADIVDTTVENKKCIELKEYHSINKVYKQIYGQNALNLLPKDYDTIAYGLTIFKDDKDILEYLQNKYVNAKGKPISNLANKTYDDTFIQVLLTLNFSKMGHLSFKALKNIIPFLEEGLSYDKACEKAGYNFKGASYTKKTKYLPVIPQNTNPVVHRALSQTRKVINAIIKKYGSPNAIHIETARELSKTFQERKEIDSMYQDNSKKNEHAICKLKELGNIKPSGINIVKFKLWNEQDGRCMYSGKYIEPHRLFEEGYTEVDHILPYSRSLDDSYNNKVLTLGTENQRKGNKTPYEYMRNNSIWDEFETRVQSNKKINKKKQQKLLLQNFSHAREQEFIERNLNDTRYATIYLSSLIQQHLIFSESSREKKVHTVSGIITSHLRSRWGFNKDRKEGHIHHALDAVIVAVTSDHMIQRVTKYYKLKELNRNIQAKRMQFPEPWEGFRLELEARVSPNTQQYLKGIRFKNYADVDLSEIKPIFVSRMPKRSITGELHQETIRKFLGYNEKGKVLTATKTKLEDIPFDANGDFPMFGKETDLYTYNAIKERYLSHKKDKRKSFQEPLYKPTKSGGIGPLIKSIKIMDTRTIVNPVNQGKGVVYNSKIARTDVFKKGEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSIIANVGSKQLLSFEKYQVDVLGHYTKIKKEKRIGMAI

SEQ ID NO: 512 - protein, 1143 aa, Sulfurovum lithotrophicum
MSKKILAVDLGITSFGFSVLKEVEENSYINIDNSVIMRDAPYDKDGKSKQTSRREQASQRSLGEKRRQRIKEVAKTFNSFGVLSYDECMQVQKNNTITDKWKLRAEDALYRILSPQELFAIMAHMAKHRGYKSIATEDLLYELELELGLVEEQTEEEDSKTDEKRQVYAALGRLKRLKETYKVDTIAQVIHKAIQEGKFRSYRNHDDYEKMVRREDIEYEIETIIKKQCELGAFAFDGERCLQFIEVLHEAITDQIMPENDESLFGQCSYYANEKAAPRYSYLYDIYRLYKTLADLKIDYYDLTQEDRDKIVDFVIQKIAKGKNLKQVYYKDIRKILGLSNEQKLYGKDDQVVIKGKSSQRTLIKFFFLNEIGKFPTLMQKILSHTEALNIFAQLAEVVRFHKTPKLALAALHELLEPYGIEVEATELLALIKSKSAGTLSISHRFILDALPYFNEGKDESFVKEILGISPSEDYNTYPKSLKYLHLGKDNLFEKTQNAINNHAVKSLASWALQNIADLSWRYGSFDEIIIESARDVLPQVIKDAIEKSMKERGKEIDKIIESYKKEFPSMDRKMARKIKLLESQKFIDIYSGEVINISDLFNGRADIEHVVPRSLGGLSTDYNLIIANSDTNMQKSNRLPMDWLSGDIEYVKRVEMLFNGHKINWKKRKNLLATSLDEIYVEVQDTKALRATSYLESLVSEVLKMYYPFPNKEHRKNGVAVRNVPGKTTSKTRSWLGIKSKSRDTNFHHAEDALILATLNRGWQNRLHRMLKENYGKSEEELQLLWQKYTPHIEGVAIAGYIKEAYERFMSKGEESLWYRDMFGSIRSVSYWVSKKPLSASSHKDTVYSSRHRNPNNPDKVVPTVRKSILGAFNGLDILKNRHKWNKEEFLKVYDKEIRQKLWLYRLDNTNDPVYRAIEERANTIGNLIEIYIYKDPQHDKAVDEVYQEVIRSLLQKPITAAGKPVYKTVFVDDTFLPIEIERGESNKVLVRTDDNFLAVMFEKGEKEKLNISKVDVNSLHRLKKENAMIVYLNEVIYLFNKKKIIHYGALRSFKILSSGARYISLFNPRFPANPSSQPKKFTDGKSIKSISIGSTTGVIKVHLDLNGKMKSYQKFGFIPKELEAQFLKESGYGIVEDDTNH

SEQ ID NO: 513 - protein, 1133 aa, Alloscardovia omnicolens
MTLNNYKIGIDVGLYSTGLAAIEVDSNGEPVRILNMQSVIHDGGVDPNSNKTADTRKMISGVARRTRRMRRRRKSRLANLNKYLEELRLPLENYGDDTFEPWMLRACLADGYIQDEEQRKYMLSVAFRHIARHRGWRNPYKSVKSLYNVNLDDLSERYDDLCEACQVNPEDGLTPAQIIGDYLASKDGQVAPRIRHSGSKSEAFAPLPQKLMQEDNAYEVRYICEQQGVDDETCRKLIDKIFYAVSPRGSASERVALDDLTHEKRATKASLAFQKFRIIAALSFLKLAVGGQQRPLTVEEKNTAFDILSSMDSKTRPTWADVAAALGVNRRDIKGIGGIQDDGDRISNRAPVMDSYFALIESSGVLGKLVKHDIMPWWRDASEDDQERLLELLGNNVDIDSIRDDMSYSNAFELIDSFDDDQLGVIDNIKLPAGRAAYSVSACQALTVRMLSTTDNLHDARKTVYGVTDNWKPAQEPIGFPIGNPSADRVLKIVNRYLMNCTARWGTPVSVNIEHAREGFSSAKVARAYQKDAEAYATNRSAIFDKIKDLYPDFNRFSDSAMKRWEAIQRQNGECLYCGATLKFTTCELDHIVPRKGVGATNTKTNLAAVCTDCNRAKSKKLFSLWCHDQYAVSKGITVAKAVARVEMFTFPAGTLSAANAKRFKEAVKSRLTQMTEDEAPDNRSIESVSWMADELHKRIDWYYNSQRYTATSDIPERAVKVFVYSGLSTSLARRFSGIEKQIHFAGPSGKTRLDRRHHAVDAAVIALMQHNVAEVLVDKNELYKAQRYSQKEDGADWREYRGKDEEQQFLYGRWLGNIHVLLDLINDALDDDRVQILRNLRLELGNSRAHEDTIHKLLRVRLGDKVEASLVQRASTPALFTALTRCDDFDEKTGLPENRERHIVVNGVHYGSEDEIAFFEKNAAQIMVHNGSAEIGDGFHHARIYLCDKINKSGKKTGEFYGMIRVFAADLAKSRNDDLLTVPLSESSLSMRYGDPSTVKAIREGHARFVGHLFVGDELRLDLSQTDYTGQVQEFAQVLANVAEAEVYTTWVVDGFCDPAKLRLRPSYVSSEGVKSFDEAEQSRLLKVIDKGWRPAINALSAYYPTVVRRNGLGEIRWKSNAGLPMSYRWHE

SEQ ID NO: 514 - protein, 1129 aa, Streptococcus infantarius
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 515 - protein, 1509 aa, Bacteroides coprophilus
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWADVNLKKIKVYYFTKETNERFFATRKSLDPSFDQKKIEEEVTDTGVQKILLHHLQQNNNDPDMAFSPDGIDRMNQNMTILNDGKWHQPIYKVRTYEKADKFAVGESGNKAKKFVEAAKGTNLFFAVYESVQEDEAIGKQVCKRTFATIPLNEVIKRKKQGLPAAPEDLNGNLPKFVLSPNDLVYLPTEEERNSSRIIQPLDRERIYKMVSSSGSQCFFIKVFVANSIWDKNEYSSLNKMERAITNEMIKEICVPIKIDRLGNVSLIQI

SEQ ID NO: 516 - protein, 1375 aa, Prevotella sp. oral taxon 306
MKKILGLDLGTTSIGWALVNESENKDEQSSIVRLGVRVIPLTVDEKGNFEKGKAITTNADRQQVHAARINLQRYKLRRENLRDCLQKQGWIGSEPMCEDGKSSTFETYKLRAKAAVEEVSLHEFARVLFMLNKKRGYKSNRKANDKEEGKLFDGMTIAKKLYEEHLTPAEYSLQLLNTGRKFTPEYYRSDLIEEFEKIWNEQQKYYPEILTDEFKQQLEGKAKSNTSKLFLGKYGIYSADTKGLDRRLQPLKWRVEAMKQQVDKDVLAFVISDLKGQIANTSGLLGAISDRSKELYFSKQTIGQYLWASLQENPHISIKNQPFYRQDYLDEFEKIWETQATYHKELTSELKQEIRDIIIFYQRPLKSKKNLIAVCELEQRKVKVTVDGKEKEITIGPKIAPKSSPMFQEFRIWQNLNNILLLDHETNSKRPLYEEERNLLYEELSVKEKLSKTEALKVLGKKSKQWDLNYKELEGNRTQAVLYDCYNRIIVMSGHEECNFKKLKASDIRHYVKMIFKNLAFNTDILCFDSSLKGHELERQPMCQLWHLLYSYEGDNSRTGNDALLRKLETSFGFPKEYAAVLADVIFEDSYGNLSVKAMRNILPHLQAGKDYSQACEEAGYKHSRRSLTKEELNQKVYKEKLELLPKNSLHNPVVEKILNQMVNVINAVIEEYGKPDEIRIELARDLKIGAAERENMTRSINQGNAENKRIREILEKEFALSYLSRNDIIKYKLYEELKSNGFKTLYSDTYISKDKLFSKDFDIEHIIPKARLFDDSLSNKTIEARDVNIAKSNKTAFDFILERYGEQGVKTYKTKLLRLLEDGAISNKKYNNLLKTEADIPSGFIDRDLRNTQYIAKKAYEILSELVKIVTPTTGSVTNRLREDWQLVDVMKELNFEKYQKLGLADVIEDRDGRKVKRIKDWTKRNDHRHHAMDALTIAFTKPSYIQYLNNLNARSDKSSSIYGIEVKELHREEGKFRFNAPLPINEFRAEAKRHLKSVLVSIKAKKKVMTQNVNKIKTKHGIIKKVQLTPRGELHNATYYGTKKRPLVRMVKVGAALDEATIKRVCSPAIRAALLKRLNAYNGDAKEAFTGRNSIDKNPIYLDIEQTKLVPVLVKTIEWGMYHPIRKRITPDLKIDKVIDKGIREKLKARLAEFNGDAQKAFSNLDENPIYMDEAKRITLKRVSIEGVLSAIPLHTLKDKAGKPVIGSDGKPVFGDYVQTSNNHHIAFYIDDKGNLQDNPVSFFEAAERKSQGVPVIDRRYNCDKGWHFVFTMKQNEYFVFPNEATGFIPSEVDLLDEANYCIISPNLYRVQKLSKASGRDYWFRHHLETMLNDDLRLKNSTFKRIQSLKGLEDIVKVRINSIGKIVAVGKYD

SEQ ID NO: 517 - protein, 1494 aa, Prevotella melaninogenica
MKTILGLDLGTNSIGWAKVCVNDNGNYTREIKLGSRIIPMSQDTLSNFDKGVTESPTAARTGFRGIRRIRERALQRRERLHRVLHVMGFLPLHYENAIGWNREEATTYGKFLDNGEPKLAWERQEDGSMRFLFMDSFYEMMADFAKYQPGMVADGRKIPLDWTLYYLRKKALTQAIRKEELAWILLNFNQKRGYYQLRGEEEEENSTKHEEYYELKVVSVEAAEEGKGGNTWYNVTLENGWIYRRQSKIELNDWVGKVRPFIVTTEYEIDGVTIKKDKNGEVKRSFRAPSENDWGLRKKRTESLLEESGKTVGAFIYNHILSEPADKIRGNFIRTIERKFYKKELEAILREQSKHQKELKDIDTLIACIKELYPNNKPHQDSLIKKDMTYLLITDLIFYQRPLKSKKSLIADCPYEYYEYVIKETGENKRQSIKCIAKSNPYYQEFRLWQFIINLRLFDRNNDKEVTSEYLSSMEDYTRLFTYLNDRKDINQETLLKDFFKQKKVKRGMEKEFPIRWNYIEDKEKKYPCNETRHELLTALGKVGIDHSWLDDKELFYRLWHLLYSVESKEEAEGALRKLVDNDDFVNAFLKIKPFKKEYGAYSEKAIKKLLAVMRMGNLWNEVDICEQTRDRIQNIIKGDIDEKIKDRMGRTFSQLSDFQGLPEWLACYVVYGQHSEATDIQRWTKPENLMAYINGFKQHSLRNPIVEQCILETLRTVHDIWKEAGHIDEIHIELGRGMKSTADQRARMSKSIMQNENTNLRIKSLLMELKNAKEFENVRPYSPMQQEILRIYEEGALQELTKEDAQYNEISKISQMAQPSANELLKYRLWLEQKYCSPYTGKPISLSKLFTSAYQIEHIIPQSRYFDDSFTNKVICEAEVNQLKSNMLGYEFIKKHGGEIVRCTMIGDVKLLDAKEYYNFVTEHYTNNRRKKEKLLMEDIPQEFLNRQMNDSRYISKKVMAILSNIVREEDEQEAKSKFVIACSGGITDRLKQDWGLNDVWNSIVYPRFERLNKLTNTENFGRWENKKGKQVFQTSVPLELQKDFSKKRIDHRHHAMDALVIACASNNIINYLNNESAKSQEKREDLRKKLCDKNRIIRKPWETFTQDAHTALENVVVSFKNYIRVINKATNYYEKYDKNGKKEIAEQKGQDMWAIRKPMHKETVFGQVNLRRKITIKLKDALEKIPAICDKELRDYINILVAKQFNKKQILAHFKSINYRLNMKSVDKVDVWQFSNEKEPMVATRKSVDTSFDTKRIATITDTGIQKILLNYLKAKNNDPNIAFTPEGIAEMNKHITEYNNGKQHQPILKVRVSEPKGAKYQVGETGNKRSKFVEAQKGTNLYFAIYEDKEGNRSYNTIPLNEVIERLKQGLSPVPDANEKSIPLKFHLSPNDLVYVPKTDEENEIKMGQIYKFVDSSGTTANFVPHRVSNLIYNVDKKIAENFCNHEIIQNEYGIGSPQSKNQKSITGEMIKAVCWKLEVDRLGNIHKIIK

SEQ ID NO: 518 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 519 - protein, 1084 aa, Phascolarctobacterium succinatutens
MKYAIGLDIGIASVGYAVLALDHEENPWGIIRLGSRIFDVAENPKDGASLALPRREARSVRRRLRRHHHRLERIKNLLINTEFITKDELLHLYDGNLSDVYELRVKALDYSVTNAELTRILLHLAQRRGFKSNRKSDANDKEAGQLLEAVSANAKRMQENHYRTVGEMFYKDDLFSKYKRNKGGTYLTTVHRDMIAAEARTILEKQFALGNNICTQDFIDKYLSILLSQRQFDEGPGEPSPYAGNQIANMIGKCTFEPNEYRAAKASYSFERFNLLQKVNHLRLLLEGKSIALDNEQRKKIIALAHDKADLRYSHIRKALGLDEKVLFNTITYNDDVSVIEKKTKFNFLQAYHQIKKVLAEDMQKLTTEQLDNIGQILSTYKSDNKRTEELSALGLEKKIIDALLGINGLSKFAHLSLKALRKINPYLEEGKIYNEACTAAGYDFKAHANTQKTELLPAYKEEMDDITSPVARRAIAQSIKVINAIIREQKGSPLYINIELAREMAKGFDERTQIDKANKENQAKNERIMERIRTEFHKANPTGMDLIKLKLWEEQDGRSPYSQKAISINRLFEPGYVDIDHIVPYSISFDDSFKNKVLVFSDENRDKGNRLPIAYLQSKFGAKAAENFMIWVQSNIKDYKKRQKLLKREITEEDINKFKERNLQDTKTISRFLYNYINDYLLFAPSDTGKKKRVTAVNGTITAYLRKRWGINKIRANGDKHHAVDAVVIACTTDKMIKDLSSFSRYHELEYTHTDTESFLVNSLTGEILKRFPYPWEDFRPELMARLSDNPADALRKLNLIFYHGIDLSTIKPIFVSRMPRHKVTGAAHKATIKSARCLDNGIVICKTSLQNLKLDKEGEIANYYAPESDTILYNALKERLRSYDNKPAKAFAEPFYKPKADGTPGPLVKKVKVYEKSTLNVAVQQNTAVADNDSMVRVDVFHVKGNGYYLVPIYIADTLKKELPNKAIVAYKPYADWPVMDDSNFIFSLYPNDLIKFEHKNSVKFAKVNKESTLNDFYSTKSEIVYFKGCNINTGAITIINHENTYVVSSLGVKTLPSLEKYQADVLGNYTKVKKEVRKPFR

SEQ ID NO: 520 - protein, 1361 aa, Anaerococcus tetradius
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNLDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAEDNTDSDGFYKYIVKILKDIKENDSDEDIKYILSEIDKKNFVPKQRTKENSVIPYQLREIELRKIIDNQSKYHKFLNEVDEKGISVKEKIISLLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENMSGDIVITGIDGDFKQGLKSYIAFKDIIGEKIDDDIYRKEVEKIIRDISLYGDDKSFIQKKIKNENKLDLSDDQISKIAKLKFKDWGRFSKKLLVGIKASDKNTGEIDNIIGFMRNYNYNIMQLMANVFTFKDEIEKLNSKYYTDEKINIDYLDDLYLSSPAKRMLWQSFQIVDEIKNIKNSDPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLKRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPIKENNNKSDTNKYGGYSGIKNAYFVLLEDEKHNRILEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARPKFEHLSIEEQIKTLTQMLILFGRENNAVNLEYIGLPKNTGKTKINKKINNKDIKIINQSITGLYETEEDLANI

SEQ ID NO: 521 - protein, 1052 aa, Blastopirellula marina
MPSKSPSVSPLLLGLDIGPSSLGWALFSESGDQPSLVDCGVRIFPEGVERDQQGGEKSKSQSRRVARGIRRQVRRRAQRLRHLKHALITTGLFPADVVDQQEVLASNPYELRSRALSEKLEPYEIGRILLHLAKRRGFLSNRTTDRSGGNELKGILAEMTQLQGEIAAHGCQTLGQYLHQLGDDGETFAQRLRGRHTLRAMYEDEFEKIWERQASYYPALLTEELRGGEEGKQSYPLVPTARRKSESLLKRFGLHGLLFFQRKMYWPKSVIGRCDLEPKEKRCPKADRLAQRFRILQEVNNLRLISPADRKEYTFAEFVGAGADKKLVDYLCEAKERTFPQIRKKFKLPETISFNYERGERSKLQGHETDAHFNGKKGLGKRRWSEIAEDVKDHIIQIVLEEDREDVALRKLTQDCSLTVEEAHKAMALHLPAGYSQYSRVAISRLLPHLELGKLLMGNDASDSAMHAAGYLRPDEREVRQYDLLPEPPDIPNPLVRQALYEVRKVINAIIREYGALGTIRVELAREAKKSAEQRTQIRIANAKRERENAAIAKTLQEMSPAIRPTRRNIQRYLLWKDQGGVCIYTGKVISQAQLFDSGEVDVDHILPRWRSLDDSMANKVIAHRSANNEKGDRTPWEWLGHDKPRFDELLLRAQRLPYGKRQRFIQKEVELTNFVERQLRDTTYVSRLVVQYLKGLGVPITTVKGPMTAELRHHWGLNALLNEDGSQKKNRSDHRHHAIDAIVIGLTDAKRLHALANARGKDLQPPWSEFRSDVATALGRMAVSHRVRRRIQGALHEETIYGPTQKAAQPTSTDQRPWAKDWIEDSQIVVRRKSVSDLTNTKHLAKIRDVTIRKILEDHLRRQKVDPTKPGVIPKDAFAGSNAPQMPSGVPIKKVRLVERGETWRKIGSGEASKFIKPGSNHHISYFAISRKGRESWKAHVTIMLDAACIAKESINNGKIVNRSIGDQGRFLMSLSIGEMFEITNNGGEILLCVVRKIDQSGRIYYKIHDDARESMDLKKDNLYMSPSKMQQFDARKVTVTPLGKIRNAND

SEQ ID NO: 522 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 523 - protein, 1528 aa, Lunatimonas lonarensis
MKKILGLDLGTNSIGWALVEQDFKNKQGNIMGMGSRVIPMSQEILGEFARGNTKSETAERTRLRSVRRLRERHLLRRERLHRVLHILGFLPKHYVNQIDFQERLGKFFEESEPKLAYDTGDFLFKPSFLEMLEEFKIHQPSFVEGDKKVPYDWTIYFLRKKALTERIEKEELAWVILSFNQKRGYYQLRGEDEEEKPNKLEEFYSLKIVDIKVDESPNKKGDTWYSLTLENGWIYRRSSKVPLDDWLGKTRDFIVTTDIDEEGNPKLDKEGNPKRSFRAPSEDDWGLRKKKTEKEILDSSKTVGHFIFENLLADPTQKIKGRLVRTIERKFYKDELKQILVSQNRFHPELSDADMMADCVRELYKHNHSHQNFLASKDIKHLLVDDIIFYQRPLRSQKSTIGNCPLEFKTFKKDGIEIKVPYKVAPKSHPLFQEFRLLQWVSSLRIIRKSDDSDVTREFLGTQDKTKQLLDYLMTQSEMDCNKLMTFLLTQEGYKRKDLKSEVGKFRWNYVFDSETGESKTYPGNSTRAEFLKRLGKVEGFDFSKYTEEFEESLWHLVYSVTDKVEFEKALRKFSRKNGIEINSFVENLKKFPPYKSEYASYSLKAIKKLLALMRFGENWKEDSIDSISKHRIEKILTGEYDPEIKDKVREISRAFDEVEDFQGLPVWFANYVVYGRHSEASELIKWTSSDEMADFIKEFKQHSLRNPIVEQVVLETLRVVKDIWDKYGHGQKDFFDEIHVELGRELKNPAEQRARLTTQISANENTNLRIKSLLVELLHDPGVENVRPYSPMQQEILKIYEEGVLKSSFEVPDDILKISKTAQPSSSDLKRYKLWLEQKYRSPYTGKIIPLNKLFTPAYEVEHVIPQSRYFDDSFSNKVICEAAVNKLKDNRLGMEFIKCFHGQRVSLGFGEEVEIFSESAYKAFIQDNFPKNPAKKRKLLMDELPEQMVERQMNDTRYISKFVTSILSNIVRSEENDTGFNSKNIIPGNGKITTALKQDWGLNDVWNELILPRFERMNQLTGTTVFTAWNENHQKFLPTVPLEYAKGFQKKRIDHRHHAMDALVIACATRDHVNYLNNEHALGKNYKGKEEKQSRRFDLRQKLCLKKKNGHSQEQYEWIFSKPWDSFTQDAKKNLERIIVSFKQNLRVINKTSNKYLSYKDEEGNLRLDSQGKPVKALTRQIKGDAWAIRKSIHKDTVSGLVKLRRVKMVNLSVALDNPENILNKKLKKKIAELVKLNYDNKLLLKYFRDRDYMFDGREVSKLDVYYFEEGLAASRVSLDTSFSDKKIQSITDTGIRKILLAHLANYHGRLDEKGKVIPPETLAFTPEGIEELNKNIKGLNGGKFHQPIFKVRTYEPKGNKFQVGFKGNKNSKYVEAAKGTNLFFAIYLNDEGKRSYETIPFNVVMERLKQGEGPVPQTNEKGGKLLFHLSPNELVYVPETDENYTNVDFKNLSKEQVEKIYKMVSSTGSECHFVRADISSLIKGYDAKTKVGELGSLNKQEVTNNGMTRIKEKCWKIKIDRLGSI

SEQ ID NO: 524 - protein, 1270 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 525 - protein, 1340 aa, Dorea longicatena
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLKI

SEQ ID NO: 526 - protein, 1054 aa, Staphylococcus pasteuri; identical to SEQ ID NO: 169

SEQ ID NO: 527 - protein, 1139 aa, Streptococcus sp. C150
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLSCDVADIKGYRIDKSDKAEIHTFEAYRKMKTLETLDVKKMAREELDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFRTHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKDKSQFLMYQKDRRTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQIFRFWSRTGKDNPKSFEKHKLELKPYEKTRFEKGEELKVLGKVPPSSNRLQKNMQIENLSIYKVRTDVLGNQHIIKNEGDKPKLDF

SEQ ID NO: 528 - protein, 1036 aa, Rugosibacter aromaticivorans
MLHKMHYRLALDLGSTSLGWAMIRLDADNQPCAVIKAGVRIFSNGRNPKDGSSLAVTRREARAMRRRRDRLLKRKARMMRTLIEYGFFPAEAAQRKALETINPFALRAKGLDEALTPAEFGRALFHINQRRGFKSNRKTDKKDNDSGALKTAIGKVRATIEAEGCRTVGEWLHKRDVAGLTVRARYHQDKVIKEDGKTKIDKYYDLYIDRAMIEQEFDELWKKQAELNPALFTEAARADLKDVLLHQRPLKPVKSGRCTFMPDEERAPLALPSTQRFRMYQEVNNLRILRDGLKEEPLTLKQRDDLIAALEKNSKHSFTQIKTLLGVGGAVQFNFEDLKRQELKGNTTSAILSNDKHFGKAWFTFDEAKQDAIVLQLVKEENEAKLVRWLQDETGIDEKRAEAIANVGLPEGYGSLCAKALARILPELRRDVMTYDKAVQAAGFEHHSRLGSNTEIPGLTFKIESIDQDSGEVKQFHIHKVLPYYGEYLQRHVGFGSGEPEDPAEKRYGKIANPTVHIGLNQIRLVVNALLKRYGHPSEVIVELARDLKQSKDQRDEESKRQAENQKRNKRLRDAIAGTLKISEERVRRDDIQKMILWEELSFDPADRRCPYSGAQISATMLLSDEVEVEHILPFSQTLDDSLNNKTVALRQANRIKGNRTPWDAFGAQAVAGFDYESILVRAEGMPKAKRYRFAENGYQRWLKDDASFLARALNDTRHMSKVAFEYLKLICPNTRVIPGRMTAMLRAKFGLNDVLGLNGEKNRNDHRHHAVDACVIAVTDQGLLQRFAKASASAREQQLNRLVENMPLPWGSYREHVQRAINAIWISHKPDHSHEGAMHNDTAYGLRGDGKVSFHKMVEGVRTHSEDNLKVIEISNAKATDRHGLLPNGEPRPYKGYKGDSNYCIEIVRNEKGKWEGEVISTFEAYQLVREHGIARLRHSTLSVSGKLLVMRLMIDDVVRLIIDEQTRTMRIATLSGNGQIFMADTSEANVDARNRSKEETFAYVSKMAGSLQKANARRINISPIGELRDPGFKE

SEQ ID NO: 529 - protein, 1190 aa, Gardnerella vaginalis
MILHMEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFTPWIFRAKLADEYIADEKQRKQMLSVAIRHIARHRGWRNPYQSIKSMTQETEYSEFYNELLKNIEKFAPGVSCEGSTPAQLVRDYLLSQQGKASRRLRITTDDRRKNHPNSLDPVLPRKLMQSDNMLEILNIFNVQHIDNKYVREQIINAVFYAKSPRGSAENRVGKDAITGKGKRALKASLAFQKYRIISTISNLRIRENSKERCLTIEEKQSVYKLLTTSTDEYSKEKSAEAPLYTWIDVADCLGIERYKLRGVGSQIEDGESVGNRPPMLNSELAILYANAKSLKQSLITWWLAANRTQEDKEAFIEILSNTVDIEAIHDNPEYQDKYGSVIAFIDSMDETEIAALENISLPNGRAAYSLETLDKLNKQMLETDDDLFEARKKLFNLPNNWRPSEAPIAEPTGNPSVDRVLKIVHRFLISAKNRWGNPERINIEHVRSGFQSKKMANSYKKLLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEESTYCKNHDISVDSAINRVRAFIFPPNSYDKRGASQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLELLNEEMRADRIAVVNSIRLRYSNSSVHKDDVHALLKLHVGDEIDSETIRRASTPALYCALTRNPDYDVNNGLPENTDRTILLHDKKLNADDSITFFKSKAAQLFVREGSVEIGNSIHHLRIYEYFEKLKSGKVKKSYGMIRVFQDDLHRYIHEDLFSCDLPEQSISMRYADTKVAHAVQTGNANYLGYLVPGDEIIVDFSHVKLSGYIGEFVEFLNKIGANCAAYKHWVVAGTDDKTTLILKPSMISSEGIDKLYSNCERNNFDYASYEKSIDKILVDKGWRVSVNVLDQYKAATIRRNALGEPRWASRSHLPISWSWDTGENRE

SEQ ID NO: 530 - protein, 1038 aa, Helicobacter muridarum
MKKLAFDIGIASIGWAFVEDDELRDCGVRIFTKAENPKNGKSLALPRREARAVRRRLARRKTRLNSLKRLLCKELGFNLNDYLSNDGVLPKAYETNKDTKSPYELRTLALSQKLDSKDFARVVLHIAKHRGYGNKHAKIGSDKDSGKVLSAIKANKQAMEDKEYKSVGEYLYNEFYQKQRLESEKKVSNHASEFKNVRNKGKSYEHCVAQEQLKAELELIFKRQREFGVSLSKEFEDKVIDIAFFQLPLKDFSDKVGECVFCEGQKRAPKDSLSAMEFVALTRIINTLRNLEKRISNKTYSKEKVQEILQIVLDKGEISYKKLREILSLPDYVRFSDSKLDYTKELKEVEKAKFIELKNLKAFKKALGRSFDEFSRDSLDKIAEAIALNKSRENLKKELEKNFAQILRQEQKEALSDLSFAKHIDLSLKALNEILPFMRGESSNECLRYDEAVERAGLKEIAKNKEQGNFLLALKEYEPYLANPVVARALSEYRKVLNALLRKYGQVHKIHLEFTREVNLSHEERKKVEKEQQANFTKNQEAEKLCKEIGLHISKDSILKAKLFIEQGEFCAYSCYKITSDHLKDPNMLQIDHIYPYSRSFDDSYMNKVLVFNKENQNKGNRTPFEAFGSDKDKWEKILSLADRLPKAKRKRIYNKDFKDKEAGFILRNIVDTGYIARLASQWTKHCLKFLPLSENEVTIAGEKGSKVHVEIISGKLTSMLRHYWGLGNKDRSNHLHHAVDAIIIAYASAKTIKAFADFRANQDKNTAEFYAEQISELEYVEKRAFFNPCKNFRKKVLEKLNSIFVSKPPRKRARGALHEETFYSFDDKNLLKSYGGEKGIQKAIELGKIRQIGTKIVSNGTMVRVDIFKDKKGKFYGVPIYTMDFALGILPNKAVVGGKDKEGVIKDWKEMDSNYEFCFSIFKDDLILVQKNEMEEAELCYYKRFKTSGASIEVVKHDNRVDNITENQEKIFKLKFDNGKKILDESLIAIQNLKIFEKYQVSPLGEVQKAEFIPRQSISLKSTPNKNKLNKVNEVKS

SEQ ID NO: 531 - protein, 987 aa, Campylobacter jejuni
MARILAFDIGISSIGWAFSENDELKDCGVRIFTKAENPKTGESLALPRRLARSARKRLARRKARLNRLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 532 - protein, 1048 aa, Acetobacter aceti
MANIAENLVFGIDLGIGSCGWAVLNQKAKDENIVALGSWCFDVPETDKERIPTNQIRRANRLLRRVIRRRRNRMAEIRRLFASKGMLDTADPDALAKISADPWEMRAKGLDYQLTPQEFAVALGHIAKRRGFKSAAKRVSTNAPSEDSKMLAALEKTKEQSAQYRTIGEMFARDPAYADRRRNRDGCFDRTMSREDLFKETQILFESQRRLGNFSATSETEQAFIDIAFRQKPMQDSERLVETCLFEPDEKRASRFAPSFERFRLLCRLVNLRVTDGLEDRPLTPEELRLACEDAGKTRKLSVKKVRSLIGLRDDQRFTTIPPDQEQHDIAARTGDALTGTATFRAILGESFWRQLLPHPEQLDRAAWIISFHELTDTIISKLATIGLPSEVMELIRKALEDGKFSKFKGAASLSDKAARKLIPFLQEGLTYDKACQKAGYNHAASKFTHYDSIDTKAKFNSLMDDVRDSITNPVARKAISEGMKQVWAMRNQWGLPGAICIELARDVGNSAEKRREIESGIKKNTAQRERERQEAKEHLNQSDISSETLLRYRLWKEQGGRCCYTDQPITPSQLIASDNSVQVDHILPWSRFGDDSYLNKALCTAKANQEKKNRTPWEWIHNQKGVEAWNHFTAAVESRKETRGLKKRNFLLKSSKETEERFRSRNLNDTRYAARVMAEAVRLLYPSGNRAEKGGVKRVFTRPGALTAALRHAWGVESLKKINGKRLNDDRHHALDAAVVAAVSEKEIQKLTKSFQICEQKGLARPMRDVPMPWEGFRHQLETAYADIRVARPERRRARGKGHDATIRQLREEKDGPVVYERRAISDLKLTDLERIKDPERNSAIISSLRTWIEKGKPADYPPQSPKGDEIRKIRVMSRNKPAVSVRGGTADRGEMTRVDVFTKMGKKGKPEWFLVPIYRHQVIDRIQWPQPPNQAAANGKSEKNWPTMGLEHEFRFSLYPRSYVQIVKRDGEIIEGYFAGLDRTVAAFSLLSSSDPTSIQRGIGAKTLESIRKYNVNRFGDISMVEQETRTWHGDVCISPDQPDSA

SEQ ID NO: 533 - protein, 1150 aa, Actinomyces georgiae
MLLPQVGNSRAPLVRCPVSSYFRETLPKGRAEWHNAHMSASSQNVERIRYKVGIDVGLRSIGFCAVQVDADDRPVKLLNTVVHVHDAGVSPADAKKADTRKLVSGVARRTRRLYRTRKRRLVDLDRQLDGLGWPLVDPARFADPREPWFAREKLVSGRVDDADERKELLSVALRHIAHHRGWRNPYSTVESLQADAPPSEFLQGLNQRVSEKLGTELDPGLTQGQLVAKLLHRFPNAKIRGPEGILRGKLHQSDNAGELRLICRTQGLDCHITEELVRLVFQAKSPKANKEMRKRIGRDQLPGQGAHIRAEKAHPVFQRFRIVAVLANLRIREAHVDRRLTAEEMRTLTDFLLGLAGSEQPTWEELADNLNIERHQLRGTAKASVDGAPALRFPPIDATTDRIYASKLKWLAEWWRQADEERRGYMVDALSNSGGSEDEPYLDDEIAEMLEQASEEDQAKLDSLHLPGGRASYCLDTLRRLTDAMLGGGLDLFEARKAVFHVDDDWAPPTDPIGAPVGNPPVDRVLKHVARWLEAATGRWGAPQTINIEHVREGLGSEKAARELTRMNDRRRRNNQKLVEEMGEKLGMSGRIRRSDRMRYEAIRRQNCECLYCGQPITYQTMEMDHIVPRAGAASTNSRSNLAAVCRRCNHQKGKLPFAVWAESQDSPAEVRLQDAVQRVRHWLRDAGMGQKELQALRVQVIARLKSKRPDEEFDGRSMESIAWMANELRARVEAQYRGSGTTVRVYRGALTAEARKASGFEGRVNLIGGRGKDRFDRRHHAMDALVIALMNQSVAQTLALRLNMRDSQWLTQSEQTWRQFHGAPGEAARKWEAWDRDMRDASDLFNLALDGGRIPITENVRLRVGNGRVHEDGVIRFKPEYEVKGKTIKGGEARLLGDSLPSEQIDRAETPALWTALTRLPEYDRKSGLPENPDRVIRVNGAVVQATDRIRFFGTPASVAVRGGYAKLGESIHHARIYRINGKTPKYAMIRVYTIDLMRLNHEDIFTAVLKPSTISMRCAEKKLKYAIAEGNAEQIGWLVEGDQLELDAAAYAKGVGADLMREYPMATCWRVAGFPDEAKLRLRPVLLAAEGMGEDAPKFMREVLENQGWRPAVNALLSPGSVRVVRRNVLGEPRFKSSGHLPTTVDLV

SEQ ID NO: 534 - protein, 1629 aa, Francisella tularensis
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 535 - protein, 1046 aa, Helicobacter fennelliae
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFVNVRNKTGNYEHCVAQDMLKDELELIFRKQKELGLHLSDGFEKQLLDKIFEQRPLKSFADKVGKCQFIAGAKRAPKDSISAIEFVALSRIINTLANLSKKSGEMYDKAMVLTILDSVLEKGEMSYYALREAINLDEKIRFADSRLDYSKEIKETEKVKFVECKNLKSFKKVLGNCYKTLERKHIDSIAERIAVIKDVEKLHKELESYCATEQLSLTSEQIQALSHLNFSSHISLSLKALEQILPFMRGEREARSSDADYCIGIDESGESQCLRYDESVEKAGLKALSKDTLKGQILPPLNEFEPYLANPVVARALAEYRKVLNALLKQYGSPHKIHIEYAREAKLNTTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLSLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRANVLEKAESVFVSKPPRKRVRGALHEESFYSQNDTKLLKSYGGAEGIEKALQLGKIRQIGTKIVSNGAMVRVDIFKHRKSGKFYGVPVYTMDFALGILPNKAVVQGKDKNDVIKDWLEMDSSYEFIFSLYKDDLLLVQKKEMAEPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 536 - protein, 1220 aa, Alistipes shahii
MAKVLGLDLGTNSLGWALVDESENEYTLIDKGVDIFQEGVARDKNNEKPAVQDRTSARALRRHYFRRRLRKIELLKILIRYDLCPPLPEELLTAWQKEKRYPQDNEFLRWQRTDDNGDRNPYHDRYVALSERLDLGNRTQRWLLGRALYHLAQRRGFLSNRKEAGNEKEDGTVKECIKNLSAEIAAAGCRYLGEYFYGLYQHKERIRDKYTSRNEHYLAEFNAICDRQQLPDEWRKALHRAIFFQRDLKSQKGSVGRCTFEPTKSRCPVSHPRFEEFRMLSFVNNIRITGPGDNAPRPLTQEEFETIRSLFFRKSKPYFDFEEIARRIAGKGKYACKEERTEAPYRFNFARTATVSGCPVTASLQAIFGDDWITEIRSLYLLGAGKNEDQMLNDVWHALFSFNDEGRLRSWACEKLQLTDEQAKAFAAIKLPQDYAALSLNAIGKILVYLRCGYRYDEAVFLANLRAALPKEVYADESRRHEIEQDIASLLLDYKRNPYNKFDSKEHRIADYFSDHGLDASRLMRLYHPSKIETYPDAQPKANGILQLGSPRTAAIRNPMAMRALFRLRNLINTLLREGRIDRDTKIRIEFARGLNDANRRKAIEQYQREREVENRKYAEEIHSQYAAETGREIKPSDDEVLKYRLWEEQQHVCPYTGRQIRISDFVGSAPDFDIEHTLPQARGGDDSQMNKTLCENRFNRETKRAKLPAELSNHVEIMERIESFGWREKMESLQKQIEAQVRRSKSAAIKSEKDDAIQRRHYLQMQLDYWRGKYERFTMAEIPEGFSNRQGVDIGIIGKYARLYLKTVFDRIYTVKGSTTAAFRKMWGLQEEYARKERTNHVHHCIDAITIACIGRREYDRWAQYVADEERYGYGESGKPRFEKPWPTFTEDVKAAADELLVAHHTPDNMTKQTRRKLRVRGRIKLNADGEPIYQQGDTARCRLHQDTFYGAIKQDGEIRYVIRKSLAQLQPTDIDKIIDDAVRDRVREAIDKVGFKTAMNPDEYTIWMNREKGIPIRKVRIFTPSVKHPIALKKQRDLSAKEYKRDYHVVNEGNYCTVIYEGQDKKGKTKRTFELVSNLEAAQYFKASADREARPDLVPQTDTNGFPLKYILKTGTMVLFYENTPAELYECTRKELVKRLYKVTAMAAEGRVQFLFHQEARDQKTLTSLYGAGTSQFCQSNPSPKLRLSVSNFNMLVEGYDFELTVTGEIKFKDDRPC

SEQ ID NO: 537 - protein, 1453 aa, Sporocytophaga myxococcoides
MKTVLGLDLGTNSIGWALIQHDFDSKKGEILGMGSRIIPMSQDILGEFGKGNSVSQTADRTKFRSARRLRERHLLRRERLHRVLNILGFLPRHYAADIDFEKRLGQFFEGKEPKLAYDNNQFIFTKSFGKMLADFRQHQPDFLKDEKSNDLLIPYDWSIYYLRKEALTKKIEKEELAWIILNFNQKRGYYQLRGEEEEENLNKLVEFHSLKIIDVVADEKLNNKGETWYSLLLENGWTYRRSSKVPLFDWKEKVRDFIVTTDINDDGSVKTDKEGNEKRSFRAPSDDDWTLLKKKTEQDIDKSRKPIGAYIYDAILKNPKQKINGKLVRTVERKFYKEELKLILQKQKEFHPELQSTDLYNECIRELYKNNDAHQLQLNKKDFVHLFLEDIIFYQRPLRSQKSSVGNCPLEFRKFKDSEGIEKVEYLKTIPKSNPYFQEFRIWQWMYNLSIYKKDDDENVTRDFLKTIEDWEDLFEFLNHRKDIEQETLLKFLLGKNGVKGKALKVEAGKFRWNYVSDKIYPCNETKALIISKLEKVKGVEEKFLTEEIEYKLWHLIYSVTDKVEYEKALKAFAGKQKLDLVSFVDSFKRFPPFKNEYGAYSEKAIKKILPLLRTGKSWNWMAIDSKVRDRINKIITGEFDEEIKNKVREKAEKHSLKKENDFQGLPLWLAQYVVYGRHSEASFSGKWNSVDDLKKYLEEFKQHSLRNPIVEQVLTETLRVVADIWQFYGKGEKDFFSEIHIELGREMKNTAEDRKEMSAIIQANETTNLRIKALLNELLQDKKVENVRPYSPSQQEILKIYEDGVLSSDIEIPDDIQKISKAAQPTKSELQRYKLWLEQKYRSPYTGAMIPLGKLFTSEYEIEHIIPQSLYFDDSFSNKVICESAVNKLKDSRLGMEFIKECHGMVVETGFGKSVTVFEEETYRDFVVQNYSKNHSKKSKLLLEEIPEKMIERQMNDTRYISKFISSVLSNIVREEVNDDGVNSKNIVPGNGKITTQLKQDWGLNDIWNELILPRFERLNVLTDSKHFTAWSENHQRLLPTVPIGLSKGFSKKRIDHRHHALDALVIACASRNHINFLNNAHAIDKKKNSEEKQKFRHDLKAILCDKKYSDKSEKNYRWIFKKPWDNFTIDSKNALDKIIVSFKQNLRIINKATNRYEKWVDRDGIKVKEWHKQEGINWATRKPLHKDTVSGKVDLKRVTVPEGKILTATRKSLDTSFDLKVIESITDTGIQKILKNYLTSKSNNPELAFSSEGVEDMNKNIRKYNDGKLHQPIYKVRIFELGSKFPLGQFGNKKFKYVETAKGTNLFFAVYEDENKNRNYETIPLNVVIERQKQGLSSVPIKSEKGHKLLFYLSPNDIVYVPGSNEEFSIDRLYRFTDSSDKTANFIPLSVSSLIFSSNKNEQKKIGISYPIQDEFGLGSPQSKNQKSIDGIMIKEKCVKVNIDRLGRVSF

SEQ ID NO: 538 - protein, 1197 aa, Porphyromonas sp. oral taxon 278
MSKHVLGLDLGVGSIGWCLIALDEQDQPAEILGMGSRIVPLTTDDLNEFSQGKAISKNQKRTTQRTIRKGLDRYQLRRKVLSEKLAGHGMLPDKDLMQLPVLDLWELRARAASPGEKLSLPEIGRVLYHINQKRGYKHAKSDEAEEVTKRGKEQGYVATVKGRYAELQREGATVGQHFACKLKEHRQESPSGGFFYNYRIKDQVYPREAYIEEFDRIMEVQSVFYPEVLTPAFIQELRDKVIFFQRPLKSCKGLVSFCEFEKQERVVQLKRVNREGKEELQERKITIGPKVAPKSSPIAQLCKLWESIHNIRIYYPDGKERPITLEEKRKLLAYLQTHDKLTFTALKKELKISDKERLWCDKLLKGGIKGDTTRVLLRKALAGYKRYEPLLRMDLELRDFQEIVSGKRLIRPIVDESYLSQPLYRLWHILYSIEEREAMRRALIDQLGFLEEDLDGGLLDKLYQIDFAKQGYSNKSAKFICKLLPHLQGGHGYSQACELAGKRHSAGSLTKEELEERPLLEHIPLLQCNELRQPIVEKILNQMINLVNALRQKYGSIDEVRVELARELKMSREEREETSKRIRSREKENKEIAERIKEYELYPTKSRIQKYRLWQEAGEQCLYCGRSIDVVQFLRGDGVEIEHIIPKSILYDDSSANKTCACSRCNKDKGNRTAYEYILAEGREAEYLDRLETLFHDGKLSYSKRRRLQWKKADIPVDFIERQLRLTQYIARQAQEILRQGIRRVGASEGSVTAKLRHLWGYDDILRELNFERYQSMGETEIVSQEEKDGSITKSERIKDWSKRKDHRHHAIDALVVACTRQGYIQRLNSLNSEEDSLQMQEDSKQMREKMGGQKRPTADKHSILENWLILQPHFSHQEVKSKVAEILVSFRPGKRTVSTGRNTYLRSGKKVTQSGVLIPRGPLSEESLYGQILRNGEPTYVKKVALESLSEAQIEQIVDPKLRREMVARTQPSEGAKLNPKLLLATPFYSDAAGTQRVRSVRVAIENGKNSIVPLRYNESGKAITFVNPGNNHHVGIYRTSEGKLVESCVTFWQAVDRVRYGIPTIIRKPREVLDQLLLRDDIPEALLAHLPASDWEFVEYLQANEMFLIGLTDEEIQTALAESDLLTLSNHLYRVQKMSSEYYVFRYHLETEVADNKNNTGIIPKFYRLRGPNDTYLKANPRKVKVNLLGEISLP

SEQ ID NO: 539 - protein, 1105 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGEEIRPCRLKNARLSVKLIYPCFRRPEAGIFYIKIRGKT

SEQ ID NO: 540 - protein, 1399 aa, Veillonella sp. AS16
METQATAQLISGHLKGYPIYDYFVGLDIGTNSVGWAVTNRIYELLKFRSHKMWGSRLFEEGQTAVVRRGFRSIRRRLERRRLRLKLLEALFADAMARVDSTFFIRLRESKYHYEDKTTGHKSKHILFIDDNYTDQDYFAEYPTIYHLRADLMENGTSDIRKLFLAVHHILKYRGNFLYEGATFDSNSSLDTVLKRALEQIEFHIFNATSEDALHSILDIVKLQDKTKSDKAKAIESLVDTYITDKVESSCTDKEKKDLLKADKKRLRAFANLILGLNANLTDLFGTIEEIEEDFVKLQITGDTYEEKRDDYAKVWGDTIRIIDDCKSVYDSIILMSIKEPGLTISQSKVKAFNKHKEDLAILKRLLKSDKYIYKNMFKADEKGLANYVHYIKQGRKNETGCSCEDFYKYTKKVVESLPDSSDKAYILNEIELQKLLPLQRIKDNGVIPYQLHLEELKAILEKCKDTFPFLNTVSDGFTVAEKLIKMLEFRIPYYVGPLNPSHSIDKGGFAWVERKEPGQVTPWNFEDKIDREKSAEAFIKNLTNKCTYLIGEDVLPKSSLLYSEFMLLNELNNLRIDGKPLEQAVKMHLIDAVFKKEHKKQTKNRIIEFLKDNNYILGKHKPEVDGLDESIKGDLASYRDMKRILGDDFDVSMAESIITSITIFGESKNMLRETLRKKFGSILSEDQIRSLAKLRYRDWGRLSKKFLIGIDGCVKGEDGTPGTIIDMMRNTSHNLMELLGDTFSFMDVIIEENDKLTKGQVVDPHEIIEELGLSPAVKRAVWQALRIVDEVIHIKKALPSRIFVEVARTNKDEKKKKDSRKKRLQELYKSIQKESPEWLSVTRDESDKLISNLDRADDSSLRSKKLYLYYTQMGRCMYSGRVIDLDQLNTDKYDIDHIYPRSLTKDDSFDNLVLCERQENAKKSDNYPIDPDIQNARKPFWTFLKDQNLISSRKYERLTRVLPLEADDLTGFIARQLVETNQSVKAVTTLLRRLYPGVDVVFVKAENVTDFRHDNDFIKVRSLNHHHHAKDAYLNIVVGNVYHEKFTRNFRKFLKKNGAKRTYNLARMFDFDVMSTNAKDGKAWDIKTSMNIVKKMMASNDVRVTKRLMEQKGALSDATVYKASVAGKAKGGAYIGMKTKDSVFSDVSKYGGRTSIKNAYSIVVEYTGKKNEIIKEIVPLPVYLINRNKTDQELIHYIVSIIPQAKNVSIIYKKLCINQLVKVNGFYYYLGGKTNNYFWIDSAIQVVIADEWIPYLKVLEKFDVMRKQNKELKVGTVSTSIQNQGKKVVIKILEERNVEFFSYLVGKLHSSIYSKMKGNKAGELATKSLEIFVNMSLENQCIYLMELLNLLTNKKAPDVKPLGITASRGTIGSKVSNQDEFKIINESITGLYSNEVTIV

SEQ ID NO: 541 - protein, 1338 aa, Coprococcus catus GD/7
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 542 - protein, 1088 aa, Oligella urethralis
MPKEFDPLKPAKYRLALDIGSKSIGFAIIFLKEDVNKLLKPYAIVRSGVRIFGDGRTPAAPGQLGSSLAAERRVKRSIRRQYARKRKRLQRLLRNLKELGFFPDDSKLCKSFEDLNPYELRHKGLTKELKPHEFGRLLMHMAKNRGFQSNRKVDLLADNIDSQAKAETSAMKSAIATLQSRLNGEFETLGAYLYERFKKGETIKSSKTQKGQKAEYEFSISRRMVKQEFDRLWAAQEQFNPELFNEQAKNTLKDTIFFQRNLLPQKVGKCTFLPEHERASKALPSSQYFRIISELNKISFTDAEGLILPISLEQRNKLLKSLRIKQKLSFDRIRTELNLDSTVLINLEHASKDSIEGDKTGYLLSKKEYFGPAWRDLSLETQDAIVTALLTHENEAELVQKLVDDFNIAHDVAKALANARLESQYMRLSKEAIERLIPELEKGVDSQDGYKVPVKYHEATEAAGFGHHSALQENWADFPTLDLKQLHSDDNDKYTVAELPLPYYGKVITRQVAFGTGDVNDPVEKRFGKIANPTVHICLNQVRVLLDEIIAKYGYPYEVNIELARELKQNHEQRQRSIKQQAANKKENEEIRREIKQAYKVEKARIITDSEISRADIEKWRLWRRSKSKLCVYSGKKICETMILNNEVEVDHILPRSRTGDNSYQNKVLVLNKANRIKSNRTPWEAKELFEAQGWSYEDILNRMRALDKHQLFRFAENSMDIWDKNYRSFEARALNDTRYISRVVKDYLKVVCHKDRIVVSNGAHTALIRREFGLNDLLGKKGEKNRDDHRHHAIDACVIGALDRSMLRKLQIAMEVAEKQNSARNFVGLQEPWFNFSTQVRRSIGQIYVSHKPNHNYEGEIFEASIYGLRLISDKRTEKYVGIKRNPETGKTDKPKKSVVVISDPKTQNRYGLRHKFHSEGLPKKYYGLSSSSVFCLEIYRDEKGNWQAYTIPRYEAYRIVKRRGVNALYDNKRSNFEGRPLVMRLMRDDCIAFEKNGVKEVYRIQKINGLKKNITLTRHFDANVDDRYRRMLKAQKAEKAGEDFDSEDLCDDLVFSSFGASSLYSNKARKVTISPMGVLRDPGFKG

SEQ ID NO: 543 - protein, 1377 aa, Lactobacillus brevis
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 544 - protein, 1218 aa, Mycoplasma ovipneumoniae
MNQKKSIAIGFDLGIASVGWAIINSETNEIMNWGSRIFKEREKGAAERRSFRTARRTIRRRQYKSEKLLKLILRSKNIFDFKNIDEIKNSFLKSSSQNSNILDLKIKALNEKIDPKDLAWILHDYLENRGYFYELDDNRETLKYYNGDKFPTQVLSEFFKKNNFFKSSKYNFSNQQWTVEIKKLFEVQNIDEEFQKSFLRLFNYIRDFAKGPGSLHSASEYGIWKFDKEKNEIVQQYDNIWDKTIGKCSIFPNELRASLNFVSYEFFNLLNELSNLRSDFDPEWKLKKEDRDKLINGLLSGEYKNITDNKIEKIIDKDLEIGKDDFKGREILNNKDEIKKKLKDKTKNTNILIKEITNHSEKYKNFKVENFVDHPEHLEALDSICSVLEKYKEKKDRFIEELDKTKVSDKINVLDYFGIINKKDEFINNLLNNKDLTFKKTGSYSAEATRLFVKKMLKTQENSEYLKYNDKEINDIIKQNAKAKPLTKYLNPFIFKDEILPPSVKQTFEQAIAVLNKIIKKYSKDYEISGIFIEIPRDKNDKKAKKKQANKTVKSGLDEIYEVINKKYNLVSLNISKEDLYHKPAPLLKKLKLYCQQDGVDLYTLKKIDIADLINNSSKYHFEHIIPKAYLPDNSLSNLLLTTQSENSKKSNLCAAAYMKSKGADDYKRYVKKINELFNPKLAPKDDSSKIFGLDKKAMLKKLKLLYQEGIDPHQKEEFLSRQLNDTRYSTKLFLEVVKEHFKDNPNFSYEQATKIFTLNGHHTAFIREKILPNNKDRTDNSHHAIDAAIIGIMANKNRHALSSLTIQEGLRQSKYEQIEDGTIIDKQTGEILKNSDYDSKKFELVENISGLVKEKIENAQDKVEIKFSRKMTNSTNSPLFDDTLYGLRQNDDGTYDKVEKINLVNPKSLDNLQDYFADPNPNSGKYLVLMYQSHKSEFEKLRTIFNRPEFNENKNQNPFHAYMDWLVSEKYIDEEEKENAKGANKLIYFDPVANKKTLFKDLRVVTEKNVNKDFEFVNKKQGEKSFRSGKNQLFALVYENKKGQLSSIPVNFLLKKFGSKLDHNFYSLDESNYDQENLKKYKDNLGIDHQSKPIFIIKKSAILKLKVDKEFDFKPENNKAKTSEEKEKVTKKSITIRPDENHYFYISGITKKKKVKDTTFSIKSVSLDKLKQKELQTQGLLNELQFISLDELGNEYESKEQKKLEEYFINKNKKVRK

SEQ ID NO: 545 - protein, 1526 aa, Prevotella sp. oral taxon 317
MKNILGLDLGTNSVGWALISVDENGNLVKDIRLGSRIIPMSQDVLGKFDSGVTVSQTAERTEYRSHRRLLERALLRRERLHRVLHLLGFLPEHYAAYIGWDRNDNATYGKFLPETEPKLAWRKADDGGYRFIFMQSFEEMLHDFKASQPSLVANGKRIPLDWTLYYLRTKALTKPIAKEELAWILLNFNQKRGYYQLRGEEEEETPSKRVEYHELKVVKVEATDEGKGGNVWYNVLLENGWVYRRQSKYSLEKWLGQTLPFIVTTDLEADGVTPKRDKDGNVKRSFRSPKEDDWTLVKKRTEDHLEKSGLTVGAFIYHHLLANPSDKVRGQLVRTIDRKYYKRELQAIIAKQMEFHPELCDAELLKACAEELYRNNEAHRAQLLAKDFKHLLVEDVLFYQRPLKSKKSLIANCPYETRQYINKETGEIKDVNVKCIAKSNPYFQEFRLWQWISNLRLLRQADGQDVTAAYIKGNEDKERLFDLLNNQGEIKQEHILRDFLKLKKPKGGEFPLRWNYVDDKIYPANETRHAINKAIKGMAVDKEEKETLGQLLDQPAVAYMLWNLLYSITDRNELARALRRFALTHGVSSVDAFVESFLKVKPFKKEYGAYSEKATKKLLQVMRLGKYWCGDELPEPAKRTKGNKQAVYDEMAHRGICKQTLQNISNIIEENIDERLMGALLNPERPLTELSHFQGLSVSDACYVVYGRHSEVAEIVKWKDADELNTFINNFKQHSMRNPIVEQCVLETLRTVRDVWEQEGQIDEIHVELGRNMKRTAEQRARDTQAIQRNENTNMRISLLLTELKNDPSISDVRPYSPSQRELLKIYEEGALENLTNQDEDIAKISRLAQPSASELRRYKLWLDQKYVSPYTGRPIPLAKLFTPAYEIEHIIPQSRYFDNSFSNKVICEAEVNKLKDNLLGMEFIKKFGGKTKGILDEEAYKLHVTTNYAHNPAKRSKLLMEDLPTDFNSRQLNDTRYISKTVMALLSNVVREEGERETRSKHVVVCTGGVTDTLKKDWGLHDVWHNLVYPRFIRLNNLTGSQNFGYWRYLNEENSKKGEDSKKVFQITLPPECQRGFVKKRIDHRHHAMDALVIACASANIVNYLNNQSAANPHIHENLQRLLCDRKREIRKPWPTFTQDAQAALKDLVVSFKNTVRVVNKASNTYLRYDKDGKKKRFKQEGEGLKAIRKPMHKETYYGEVNLIRKEMVPLKRALDDVNAIVDKELRASIKGLLRDGFNPQQVLANFKAKDFKFDKRDIKKVEVYVSSEKSTPMVATRKSLDTSFNAKRIADITDTGIQKILLNYLKANDNSPEQAFTPEGIAYLNEHIAEYNDGKPHQPILKVRVSEVKGAKFAVGQTGSKKDKFVEAQSGTNLYFAIYEDKEGKRHFETIALKVAAERLKDKQMPVPEINDAGLPLKFYLSPNDLVYVPTDEDRATAHPSIDKMRIYKMVSATDRQCFFLPFTVASVISNKVEFEALNKMERVLDASEYSSAYDSSHVNKVMVKNVCWKLEVDRLGNITKIVR

SEQ ID NO: 546 - protein, 1058 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKESAESATFMELKAWHAIRKALENQGLKDTWQDLAKKPDLLDEIGTAFSLYKTDEDIQQYLEGKLPDSVINALLVSLNFDKFIELSLKSLRKILPLMEQGKRYDQACHEIYGHHYGEKNQQISQLLPVIPTQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKVRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYVGLKARLAEFNQDPAKAFATPFYKQGGQQVKAIRVELVQKSGVLVRQGNGVADNAPGSIVRTDVFIKNNKFFLVPIYTWQVAKGILPNKAIVAHKNEDEWEEMDEGAKFKFSIFPNDLIELRTKTECFLGYYIGPDRHNGSISLREHDSEISKGNAGVYRVGVKLALSLEKYHIDELGKNRRICRPHQRRPVR

SEQ ID NO: 547 - protein, 1161 aa, Mucinivorans hirudinis
MKKILGLDLGSASIGWALVEETEQMQYNIVSLGSRIIPYNGTEGQEFEKGTGESRNSLRTKARTARKGYDRYQLRRKNLEKILLQNGMYPNEQVRALQKLELWKLRADAPNVQISLPELGRLLFWLNQKRGYKSSRSDANLDKKDTEYVATVKSRHQKIKDAGQTVGQYFYGQILENEYHRIKEQVFPREAYIEEFDAIVARQKEYYPTILKQELIDKIRNEVIYFQRGLKSQKGLVSVCEFEGREFNGHFGGPKVAPKSSPIFQLGKIWENINNIKIADIELTAEQKLVFFNYLNCHERITEAKIRELLKLSKDSRLNGQLKNGLTGNKTYSQIASCFGNKIGEYERLFKFELEVIESEKLEYTYHPKSHIPVGEKRRKYISENVEKEPYYRLWHTIYSIKDKDECRAALIKNFGIEEEIAEKLASLDFSAGGFGNKCAKVIRKILPYLMEGDKYNVAMDYAGYNHSFSQTKDENLQRVLLDSINHLPKNSLRQPIVEKILNQMINLVNEVIKQWGRPDEIRVELARKLKQSKTERNDDDNFMRKRERENEIIKADLAKYGLKATRNNVIKWRLYHEIDDKDKKLNARCIYCGQPISLTEAILGNNVDVEHIIPKDKLFDDSQSNKTLAHRSCNSGKGNKTAYDFMKDKPQFEEYVARVEELYKKHLISLTKKRKFLMSEDKIPSDFIDRQLRESQYIARKSREILQTVCRNVWSTDGGVTAHLRKLWGWDDVTMNLQMPKYKGIGMTEIVEWESNHGKNQHTQEVIKDWSKRDDHRHHAIDALVVACTRQGYIQRINTLNSSETKDEMHRKVAGSLVEFNQKHTLLNKYLITEKPFTTSEVEDVVSKILVSFKAGKKAATPGKRKVGKRGNKQVVQDGIIIPRGALHADSVSGSIKQYDPTGNFENHNVIKYKVGVGKGYLFDGKDDKKKIDKTIDCIVDKKIRDLIKQRAEESNYSLKKMFETPILFNQRAVFSVRCKTGNKAVVPIRNGYVVPDNNHHTAIYKYDGGLKEQCVSLMQAIERKRYNLPIIIKNPKEIYDKITEIANINQLLFDSLPKLDWEFVTTLQKNDMFILGMDYSATEEALADGNYRLLSEYLYKVQNISDGIYRLCHHTITKFDLSKANKPDKRFYNIQSLKAWNTLNPQKVKINILGQIERQ

SEQ ID NO: 548 - protein, 1434 aa, Bacteroidetes oral taxon 274
MKNILGLDLGTNSIGWAYVKQAQNDSEKSEIAELGVRVNPLTVDEKTNFEKGKPISTNADRTLKRGARRNLQRYKLRRQELIELLKDYQVISDKTILAEDGKETTFETLRLRVKSAKEQVSLEELARILLMINKKRGYKSSRKAKNEDEGQLIDGMEIARRLYDENLTTGQLSLQLLKEGKKSLPDYYRSDLQHELDKVWNFQKQFHPDILTDEFYTSIQGKGQKATRESFSSKYGIDTAENKGSREEKKLQAYQWRADATHKELTKEELAFVITEINNNINNSSGYLGAISDRSKELIFANETVGEYLWKQIQNDPHTSLKNQVFYRQDYFDEFERIWETQSGFYPQILTESLKNELRDILIFYQRKLKSQKALVSICEFESKEIPLKDKQGNPISKNGIPVTKLVGPKVAPKSSPLFQEFKIWQNLNNVLVRPKGSRKRKVTTNQQSTLLEGQEPVFELNLEQKELLFEELNLKGNLKTDYCLELIGYSAKEWEMNYPTLEGNKTNKALYEAYLKIIDSEGYDAKKLLKVKTDKDDINLDDIKVSASEIKTMISDIFNELGINTKILDFDAELERKQFEAQASYRLWHLLYSYEGDDSKSGNELLYRLLEDKFGFKREHSKTLANVSLLSDYGNLSTKAIRTIYPYIKENKFSTACELAGYRHSKLSISKEENENRTLKDTLDVLKKNSLRQPVVEKILNQMINLINELIEKHSEKDEKGNIVKYFKFDEIHIELARELKKNAEERRELDSKVREGKDRNEKIITILKSEFGLPYPTKNDITRYRLYEELKDNGYKDLYTNTYIPREKLFSKEIDIEHIIPKSRLFNDSFSNKTICYRQDNLNKGERTAYDYIEGLGKTQLDEYLNRVENLYTNKFITKAKYRNLLKKESEIGDGFIERDLRETQYIAKKAKEMLLQITRHVVSTTGSITDRLRDDWELVNVMRELNLPKYKVLGLTEIQERKNGQTVEVITDWTKRNDHRHHAMDALTVAFTKHSHIQYLNFLNARKDEKHKEYSNIMGIQQLETEKTTDKDGKDRRVFKTPIPNFRQVAKEHLESILISHKTKNKVVTRATNKIAGSKKQQETLSPRGQLHKETVYGKYRRYVQKEEKIGSKFDLQTIERVANPLYKRLLTKRLEENGGDPKKAFTGKNALAKSPIYLDETQTQQLPEKVKLVWLETDFSIRKDITPDNFKDEKSIDKVLDEGIKRILKDRLKSFDGDAKRAFTDLEQNPIWLNKEKGIAIKRVTISGVSNAEPLHTKKDHLGNEIFDDTGKPIPVDYVSTGNNHHIAIYRDENGNLQEKAVSFFEAVTRANQGLPTVDKTYNQHLGWQFLFTMKQNEMFVFPNKETGFDPQEIDLLDPKNKKLISPNLFRVQKISTKNYFFRHHLETSVETHNALNGVTYKSQLGLNGITDIIKVRINHLGDIVHIGEY

SEQ ID NO: 549 - protein, 1131 aa, Rothia aeria
MSEHTKYRIGIDVGDRSVGLAAIEFDDDGFPLSNLAMVTYRHDGGLDPTTNKSPKSRKETRGVALRTMRMRRRKKSRLKELDKTLRALGYVVPACEEPQTYEAWKSRALLATTKVEGAQELGEHLVRAVRHMARHRGWRNPWWTLNQLEIASTAPSDTFAKIRERAEKEWPGMVPEEATLGMIGALAASNNVLLRPRTYRKDQPRHSKKLNVLGQEPILVDKVRQEDLLAELRTICKRQNIEDQYEKLAQAVFEQTRPYVPLDRVGKDPLQPNKSRASRASLEFQRFRILDAVAHLRVRVGVSDRRALTDEEHDKAVHFLMGYSKKDVPTWGDVADEIGVEPTHLIAPVIDDVRLNKAPYDRSSTEFEQKMKKKTRARQWWDEANLESRSQLILLVSDPTDETTRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGRPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKRDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRPQNGSVHLDTVDGVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAVEIGWLTQNEELEFNPESYLQEGGKDKLAKFLAFLPETRWRVDGFPMPDKLRIRPALLSREEIPEGVFGTEEQSLLEEALTKGLIIATKGLLSLPDVKVLRRNNLGIPRWRGGSYRPVSLDIQRAALAALDEQE

SEQ ID NO: 550 - protein, 1048 aa, Sphingomonas changbaiensis
MKRLGLDIGTNSIGWCLIEDDGDGKGRIIDIGARIFSDGRDPKSGASLAVDRRAARAMRRRRDRYLGRRTAFLKALKRFGLMPADESAAKLLADRDPYELRARALDERLEPHEIGRALFHLNQRRGFKSNRKAERKTKDAEDGKIANGAKALDQAMAESGAETLGQFLSSRDTKRVRMGSDAQGYDFYPQRRHVEYEFDTIWSRQQQHHPALLTEEARKKLHDILFFQRPLKEQEVGVCTFVHNECRLPKAHPLFQERRLYEEVNQLEITTPGAPNRKLTMDERDALILELRSRKERSFDSLAKRLKLAPGQSFNKASESRTRLRGDEVYAVMAHKKRFGDRWPHLDRDRQWAIIKRIIEEEDPDKLHAFLTGEWGLTDEQALATARAPLPELYGRLGPTATARILEELKKDVITYDEAVRRAGWHHSDDRTGEILPQLPYYGELLTRDIPPGTQDPNDPPEQRWGKITNPTVHIGLRQLEKLVNAIIKVHGRPDQIVVELARELKLNEKDKEEHNRRIRRDTAAAQLRSAKLQSEGIPDTGANRMLLRIWEELNPGEVLDRRCPYCGEPVGMRMLFAGEADIDHIIPYSRSLDDSAGNKVVAHRSCNRAKGNRTPYEKWVHDPDRWDVISTQVARLHKSKQWRFGPDAMARVEKDGGFIARQLTDTQYLSRLAGRYLSSLYPTKDDGSVYVIPGRMTAMLRRRWGLNSLLPDHNFVDNEHSNAPKNRLDHRHHAIDAAVVAVTTRALMQEIARTAGRAEDKDLDRLFEDLPQPWEGFREELGEKLVRVTVSHKPDHGRKGLPPKNRDVTAGRLHNDTAYGLTGDVAADGKTPIVVHRVPLMSLKPADISDPDRIPDPALRSALHRATDGLSGKAYDAALAGFAKTHPQFAGIRRVRVREPLTVIPIADRDGRPFKAYKGDANSRVDIWRMPDGKWLSDVVTMYEAHRRDHSDRRPHPAAKKLMSLRQNDMIAVERDGAPRQIMVVKQIWPTQINLVEHKETGNLKDRHSNETDPFRFFAPTAGGLKKMKARQVRIDPLGRIFDPGPR

SEQ ID NO: 551 - protein, 1027 aa, Bdellovibrio exovorus
MKYTLGLDVGTNSIGWAVLELNTNGEPQRIEKLGSRIFTDGRHPKDGTTLASKRRQKRHERRRRDRLHQRKKLVLNQLVSMGLFPQSEQEQQDLKSLDVLTLRANGVSKQLSAYELGRVFYYLNLKRGFKSNRKGGSEEDKANKISERIKKLQEQLKENDFKTVGQYLHDRYIKGLSTKATIENDFHLLRQLIEDEFDFIVETQSKFFPEISDEQWNTLRNRMFHQRPLKPVETGTCSLFEDKKRTYKYMPSFEEYRFLTELFNLSYQDENFHSHSLSSEQIFKVFHELKNTREATYTKIKKLLKLPSDLSFSIERSKSKDKIKISTTNHFFSKSLLFAEEWASLDLKLKDEVAEIYFSDMSVEEIKKGLLQLKIDSEIIENLLEEKVPNVQEATCSYSKEALQKIVSLILEEERHPTLIVDDLFKNEKEETSLIDRLDYYGASIPDSMQPIPQHIKDNNLTLNEDEKRYGKIANPTVHAALNQIRQVVNDLIEQYGKPTNIHIEFARDLKKSKEERDFDNRKKKKNEELNEQVRDFIEKHNQKPSAFNFERVKLWFELDAMNNQVCAYSGKTISARMVLSDEVQVDHILPFSRTLDDSLANKVLVLASENVKKRNRTPYEAFGQDTEKWASIQELAKRLPYHKQWRFAEDAIKKFEEKDQFLQRHLNDTRYISKIAKKYLGSITDPYKIVASRGQMTSIIRGKLGLNQFIQKPDGTKNREDHRHHAIDALTVALTSRSYLKRISDASARNQDPNRIPIPEPWKGFIKDADVKFNEIIVSHKVDHGKNGPFMEETCFGLIKNPNKYEEENDFKLITTKSLDSVKDPSTIRSQSLQNLAEKSGVISLAKSGVKKLRVYDVTKENPADIGLIESGLAKITHGKDKQHVKHYQKGDINYLAIWCLPQNITLKSDNHKKRKTDYIFTAIKTFDLNSKNPNDLRPHPAAKLVTKVYKGDTVALEVNNQLNYYIVKSIRAANKKLYFLKINQSSELANETQFIPAYTKLVDYKFRKVSVSPTGVITDNGPLLK

SEQ ID NO: 552 - protein, 1052 aa, Haemophilus sputorum
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMTGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 553 - protein, 1104 aa, [Eubacterium] rectale
MKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 554 - protein, 1397 aa, Joostella marina
MKKVLGLDLGTNSIGWALVNEATKEEKKEGKSSEIIKLGVRVNPLTVDEKTNFEKGRPLSTNADRTLKRSARRNLQRYKLRRRNLIEILIKNGFITKDTPLTETGKDTTHQTLKLRAKSAKEKVDLKDFAKILLTINKKRGYKSSRKVNSDEDGLAIDGMAVAKHLYEQNLTPGQYVLNLLQKNKKYVPDFYRSDLQEEFKNIWNNQKTYYFDILTDTLFEELKDKNKSQTWAICKKPFDIAGIKQIGKASDKRLERYKWRTEGLTQKLNLEYLAIALQEINNDINKSSGYLGAISDRSKELFFNKETVGENLYRQLVKTPHTSLRNQVFYRQDYLDEFETIWETQAKFYPQLTHTLKEEIRDVIIFYQRKLKSQKSLISFCQFESWEQTYIEKETGKSKTRTVGRKVIPKSSPLFQEFKIWQNLNSLEFRNSDEGEIIEFIKLDEDIRQTVFEELNLRGNLKPNDVLKILGNYISLGKVSQWKCNFEEIEGNRTNAALYNVYQIIAENEGYGFDWAKKTASEINKELKNIFPQLGIDASILDFDFTQANFDKQTSYQLWHLLYSAEEDFKISEEDKVLYGNSSVSLKKKLHQKYGFKPEYTKLLTNISLQPDYGNLSAKAICNILPYLKENNVYSEACDLTGYNHSNFLTAEEQAKRPLKPILELLKKNSLRNPVVEKILNQMVNVVNQVIETYGKPDEIRIELTRELKKSAKERANMTKSIADATRRNDDYRKTIIKEFGIPNPTKSDVVRYRLWQELASRGYKDIFTDTEIKPQELFSNKIDIEHIIPKALLFDDSFSNKTLAFKKDNLKKANRTAYDFIANDYAPNLENYIERVESLHKDRKITRAKRNKLLMLQSKLPDGFIERDLRNSQYITKEAKKMLYEVCRTVVSTSGSITDKLREDWDLINVMKELNFPKYKALGLTEKIERYDIGAEKMKEVEIIEDWNKRNDHRHHAIDALTVAFSTHSHIQYLNHLNARRDEGHKKHAAIIAIESTITEKEGNKKRRFIAPLPNFRLQAKEHIESILVSFKNKNKVVTNNINKTKRIKKDKFNTKVQLTPRGQLHKETIYGKIKQPLEKHIKLNKSFTLEQAKLIIDKRQREKVLNHLEKYAHNSDIAFNSKTLKKNPLLISDEPLKEVLCFEEVFTIRKDISYDNFKNEKQLDKVIDEKVKQALKERINQYNGDFREAFSDIERNPIWLNKAKGICVKRATIKGVSNAEPLHTAKNHLGEEVLTENKEQIPVDYVSTGNNHHVAIYEDEDGNLQEKVVSFYEAVIRVNEGLPIIDKEYNKSLGWTFKFTMKQNEMFVFPSEDFNPTEIDLLDQKNASLISPNLFRVQKFTIKDYFFRHHLETTVENNNTLKNTTWRREGLSGIYGIIKIRLNHLGEIVQVGEY

SEQ ID NO: 555 - protein, 1389 aa, Lactobacillus paracasei
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGNTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 556 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 557 - protein, 1466 aa, Myroides odoratus
MKNILGLDLGTNSIGWALVKEDFENKQGEILGLGSRIIPMSQDILGEFGRGNSISQTADRTGYRGVRRLRERHLLRRERLHRVLNILGFLPNHYAKEIDFTKRLGKFINHAEPKLSFDKEFIFKDSFNEMLKDFQQNQPGFIINKHGEEALVPYDWTIYYLRKKALTQKIDKEELAWILLNFNQKRGYYQLRGEEEEENTNKLVEFYSLKIIDVIADNEVNKKGEVWYSLHLENGWIYRRSSKISLVDWKDKVRDFIVTTDVNDDGSEKLDKDGVVKRSFRAPSADDWTLLKKKTEQDIDNSNKTVGAYIYENLLLNPKQKIKGKLVRTIERKFYKDELKQILEKQKEFHQELQNEQLLQDCVRELYKYNEQHQQMLESKDFVHLFLNDIIFYQRPLRSQKSLISNCTLEKRVSRDGVVFPIKVISKSNPYYQEFRLLQWLQNLAIYRKDDDVNVTQEFLNSIESWENLLQFLNAKKEIKQEQLIKFLLEQKGLKGNSLKTAILTYRWNYVTDKVYPMNETRSLIQDKLKKVENVATDFLSFDNEMALWHIIYSVNDKIEYEKALAKFASKHNLDEISFVESFKKFPPFKSDYGSFSEKAIKKLLPLMRFGSVWNKNNIVPSVLDRIDKILTGEYDEKIKIRVREKAEQFQLNQIEDFQNLPLWLAQYVVYDRHSEAEIAGKWNSVKDLENYLKEFKQHSLRNPIVEQIITETLRVVKDIWQQYGNGVQNFFDEIHIELGREMKNTADERKRITNSVTENENTNLRIKALLVELKEDTNIENVRPHSPMQQEILKIYEEGVLNAVENIDEDILKISKTAQPSKSELIRYKLWLEQKYQSPYTGEMIPLSRLFTSDYEIEHVIPQSRYFDDSLSNKVICEAAVNKRKDNQLGLEFIKNHHSEKIELGNGRTAQVLEVEAYESFVKKNYDKNRGKRNKLLLEDVPEKMIERQLNDTRYISKFVTHLLSNIVRKDEVNSKDDGINSKNIIPGNGKITSQLKQDWGLNDVWNELILPRFERMNNLTNSTDFTSTNTNGKIIPTVPLEYSKGFSKKRIDHRHHALDALVIALATRDHVNLLNNESALPKKDRTKEEQKSFRFDLQVNLRNKEKYFNVKEGREKEKFTTFKKPWNTLTQDTRDALENMVVSFKQNLRVINKATNYYESYTDENGNLRLDKYGNPKKELISQKGTNWAIRKSLHKETVSGQIHLDRVKVTKGKIVTATRKSLDSSFNEKSIESITDTGIQKILRNYLKAKDNKPDVAFSPEGIEELNKSISVYNEGKNHQPIIKVRIFEQGSKFPVGETGNKIAKFVEAAKGTNLFFGIYQDKTGKRSYDTIPLNLVIERLKQGLSPVPETNEKGHQLLFHLSPNDLVYVPTIDDNEQLDSNRVYKFTDSSDTTCNFIPSNISAIIFNINSKEQEKRGINYPIQNELGVGSPQSKNQKSFDGFMIKEVCIKLKVDRLGNISKT

SEQ ID NO: 558 - protein, 1146 aa, Sulfuritalea hydrogenivorans
MSGNTHGPLTFGFDIGIASVGWCVLGENRIVNLGVRCFDKAETAKEGESLNLARRTARLMRRRLRRRAWRLTKLARLLKREGLIAEASRIHIPSPVSPWRLRVEGIDRRLTDDEWARVIYHLCKHRGFHWISRAEERKAESDAKEGGRVKKGLSDTQRRMTEKGYRSAAEMVLAEFPDAQRNKQGDYGKALSRILLSDELALLFRRQRELGNPNAGNELEATILGNGNRKSGLFWEQKPPLAGADLLKMLGRCTFEKNEYRAPKASFTAERHVWLTRLNNLRVVVDGTTRSLDDAEHRLVLPLPYKQAGDFTYKQLRTALTKAGLLPEGFKFAGLSYPTGRQLDDPKAKDPESEKLVRLPAWQELRKTLKDKNLETEWEGMAGAATGGNPELLDEIARVLSVFKDGDEVTAELWKLPLPGGKAMIDALSEISFDKFHALSLKALRKIVPHMESGLRYDEACAVAGYHHSQLHAAGAGEHKFLPPFYSRRDKDGRMVFNEELDVPRNPVVLRALNQARKVLNALVRTYGSPTAVHIEMARDLSRPLDERNKVKKAQDEYRERNEKDKAAFAAEYGIAPKSREFEKFQLYREQQGKCAYSLKSLDLHRVLHDIGYAEVDHALPYSRSYDDSKNNKVLALTEENRNKGNRTAYEYLTSFPGGENGERWRNFSVAVETNKAYRLAKRTRLLRKDFSGRAAEEFRERNLNDTRYICRFFKNTVERFLKLDAKVGAGDTAEISAKRCVVLSGQTTAFLRARWGLLKVRGNSDRHHALDAAVVAACSHGMVKRLGDYSRTKELAKVHDGFPDPETGEIIDPVMFQQLHAHFPDPWPHFRAELEARLNVDDTADLRARMELFGTYAPEALETLRPLFVSRAPQRRNSGAAHKDTIYAQPERLKEQGGVTQKVPLTSLTLKDLDKLIDPHRNEKLYAAIRARLEAHGGKADKAFPAGNPLRKPDREGNPTGPVVRTVTMVIDKLSGIPVRGGIAKNDTMLRVDIFRHKKDGKFHLVPVYVYHAVAKEFPNRAIVQAKDEDEWTLIDDKFDFCFSAHPNDLLKITQKSGETIFGYYRGCHSGTAAINIALHDRYAYAEKTTSLAFSKKNPGKPIPNDKLGLIEGIGVKMAANMEKFHVDTLGNIYPAPPEQRRGLA

SEQ ID NO: 559 - protein, 1345 aa, Listeria seeligeri
MQLEIVGGMKVMKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIEEGSLTRIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGKTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 560 - protein, 1426 aa, Sphingobacterium spiritivorum
MKHILGLDLGTNSIGWALIKQDFENKQGEILGMGSRIIPMSQDILGDFGKGNSVSQTAERTKYRSVRRLRERFLLRRERLHRILNVLGFLPEHYASQIDFTKRFGKFKEETEPKLVYSNEGFIFKKSFEEMLSDFKTHQPQLLEDNKKIPYDWTIYYLRKKALSRKIEKEELAWILLNFNQKRGYYQLRGEEEEENPNKLIEFYSLKIVDVLADEPQKGKSDIWYSLILENGWIYRRSSKTPLFDWKEKTRDFIVTIDLNDDGSVKTDKEGNEKRSFRAPGENDWTLVKKKTEQEIDSSRKTVGTYIYETLLKNPKQKIKGKLVRTIERKFYKTELKQILEKQKEFHPELRQDDLYSDCVRELYKNNEAHQLTLSKKDFVHLFMEDIIFYQRPLGSQKSSISNCTLEFRKYKDENGTEHTQYLKAIPKSNPYYQEFRIWQWMYNLNIYKKEDDTNVTKDFLNTKADFESLFEFLNNRKEVDQKALLKHFKLNDKTHRWNYVEDKKYPCNETKTMILSRLDKVENISDDFLTREMEQKIWHIIYSVNDKVEYEKALKSFAGKNNLEDNSFFEAFKKFPPFKSEYGAFSEKAIKKLLPLMRMGKFWNYNNISEQSKSRIQKIITGEYDENIKDKVREKAIHLTTETDFQGLQLWLVQYIVYGRHSEAAMLGKWNSADDLEEFLKEFKQHSLRNPIVEQVITETLRVVKDIWQKYGNGAKDFFREIHIELGREMKLPAEERERLTRQISENENTNFRIKALLAEMMDDNSVENVRPFSPMQQEILKIYEEGVLNSDIEIEDDILKISKTAQPSSSDLKRYKLWLEQKYKSPYTGQIIPLNKLFTPEYEIEHIIPQSRYFDDSFTNKIICESAVNKLKDNYIGLEFIKKLGGSIVECGNGKSVAILKHDAYEDFIKKHYANNRSKRNKLLLEDIPEKMIERQMNDTRYISKYISGVLSNIVRVEDGTDEGVNSKNIVPGNGKITTQLKQDWGLNDVWNDLILPRFERMNHLTNSTDFTAWNENHQKFLPTVPVEFSKGFSKKRIDHRHHALDALVIACATKDHVNLLNNQSAKSDTKRYDLKKKLMKFEKVAYNHPQTGERIEREAPKQFLKPWETFTIDAKNHLETIIVSFKQNLRVINKATNYYEKYVEKEGTKVKERVEQKGTNWAIRKPMHKETVSGKIDLPRIKVPKGKILTATRKSLDTSFNLKTIGSITDTGIQKILKNYLQYKDNNPELAFSPEGIEDMNKNIEKFNNGKAHQSISKVRVFELGSKFPLGQSGNKKEKYVEAAKGTNLFFAIYQDKNGKRSYETIPLNEVIERQKQGLSVVDLKGVDDFYLSPNDLVYVPSEDELENISMIDFNKMSSERIYKVVSFTGNQIFFVRQDIATSVVNKAEFSTLNKMERAIDGTMIKETCVKLQIDRLGNISKI

SEQ ID NO: 561 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRTPKDSLSAIEFIALSRTINTLINLSKESGEIYNRAIILQIVESTLKKGEISYKELREIIRLDERLRFKDPRLDYSREIKEAEKVKFLEFKQLKGFKKALGESFTTLARSQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNALLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRASVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDKNGVIKDWLEMDSSYEFIFSLYKDDLLLVQKKEMAEPELCYFMSFNSSIAQISVAKHDNNFSTLTKNQKLLFSNATQEDVSGKSIGIQNLQVFEKWQVSVLGEVKRTQSYPRENISLASKAKK

SEQ ID NO: 562 - protein, 1473 aa, Mucilaginibacter paludis
MKNILGLDLGTNSIGWALIEKDTDQKNGNILGTGSRIIPMSQDIKDEFGKGNSISQTADRTKFRSVRRLRERHLLRRERLHRVLNVLGFLPKHYADQIDFKKRLGKLVNETEPKLVYDNKNFIFKKSFEAMLSDFNQHQPLLLADGKKVPFDWTIYYLRKKALTEKIEKEELAWLILNFNQKRGYYQLRGEEEEENPNKMVAFHSLKIVEVIADESQKGKAETWYSLILENGWIYRRSSKTPLYDWKGKQRDFIVTTDLNDDGSIKTDKEGLEKRSFRAPVEDDWTLVKKKTEQEINRSHKTVGTYIYENLLQDPKQKIKGKLVRTIEREFYKDELKMILKNQQKFHPELNDEHLYINCVRELYRNNQAHQTILSKKDFVHLFIDDIIFYQRPLRSQKSSISNCTLEFRKYKNENGTDQTDYLKAIPKSHPLFQEFRLWQWIYNLGIYQKEDDTNVTDELIKNIDGYQDLFDFLNNKKEIRQDILIKFLVEQTGLKGKPLSSVVAKYRWNFVEDKIYPCNETGTQIRTRLAKVENTPEDFLTAETEIKLWHIIYSVNDKADYEKALKTFAEKHNLDTHSFVENFKKFPPFKSEYGSFSEKAIKKLLPLIRLGKYWSWENIDKKTQERIEKILTGEFDEAIKSRVRDKAIHLTEEDHFQGLQLWLASYVVYGRHSEADNLDKWHTVADLEDYLAEFRQHSLRNPIVEQVITETLRVVKDIWLQYGQGAKDFFSEIHIELAREMKNTGDERKRLTSLVTDNENTNLRIKVLLSELLNDGNVENVRPYSPMQQEALKIFEDGVLNSDIEIEDDILKISKMAQPTNTELKRYKLWLEQKYRSPYTGQIIPLNRLFTADYEIEHIIPQSRFFDDSFSNKIICESAVNQLKDKQLGLEFIKNHSGTIVKLGMGKTAKILDVESYNEFVKGNYTKNISKRNKLMLEEIPDKMIERQLNDTRYISKFIISALSNIVRSESNDDGFNSKNVLPGNGKITSRLKQDWGMNDIWNELILPRFERMNKITDSAVFTAWNENNQKFLPIVPLEFSKGFQKKRIDHRHHALDALVIAASTREHINLLNNEHAKSDKRFDLNRKLRKFEKVAYNDPKTGKRIEKEVPTIFLKPWETFTVDAKNSLESIIVSFKQNLRVINRATNYSESYNDENGALRLGKDGNPLKEKIKQSKGDSWAIRKPMHKDFVYGKVHLQNVKLPKDKFITAIRKSLDVTFDLKRIETITDTGIQKILKNYLHSKENKVELAFSPEGIEDMNQHIERYNDGKKHQPIHKVRVFEIGSRFSLGESGNKKTKFVEAAKGTNLFFAVYQDDNKGKRNYETIPLNIVIERQKLGLHSVPTEDAKGGKLLFHLSPNDMVYVPTSEELEDNLASVNIKRLNTAQRKRIYKVEKASGVECYFIRQDIAYLIKNYDAKTKIGELESQNKLQTTMTDDRLKITDVCVKLNIDRLGSIAETFLGNQYGASKKT

SEQ ID NO: 563 - protein, 1100 aa, Corynebacterium vitaeruminis
MVSLKYRVGIDVGTFSVGLAAIEVDEKDMPVKILSAVSHIHDSGLDPDQQQDAVTRLASSGIARRTRRLYRRKRRRLVQLDKFIEGLGWPVKEFEEYSDPFMPWHARAELAAGFIEDEAERNEKLSIAMRHIARHRGWRNPYSKVSTLHTEVAPSEAFLAIKEEIAKVAGIKIPDDITVGQLVAFCNLGKHRLRGKGGVLSSRLLQSDHANEIIVIGRMQNLDSSLVKQLINEVFKAESPKGSAAGRTGVDPLQPSKKRALKATEEFQRYRIASLIGNLRIREGSGQRRLTKEETSLVFDHLINLKPKSEPSWLAVCEILGIDRGNLRGTATMTDDGERAGAAPPVHETTRRILNCKVKPLVAWWMEANAEDRYAMIKALANSEVDDFDSQSGAKVQAFFAELSDEDNLKLDSLHLPMGRAAYCEDTLARITKRILENGEDLYEARLHEFQTPVDWTPPAPEIGAPVGNPAVDRVLKAVSRWLETAVDTWGVPTHITIEHVRDAFTSERKSREIDRDQQRRAKRNYEVFAEMEKTLGVQNRNRSDLTRYLAVQRQNGQCAYCGTPISYQGEGKDNFEMDHIVPQAGPGSTNKRENLVAVCPSCNRSKGNVPFAVWAAKSTNPNISVKAAVERTRHWLADPGLNATQFAKFRKAVCDRLSRVSIDEEIDARSIESVAWMANELRGRIAQRFAKDGTKVAVYRGELTAKARGASGISKRLVFLDGYGKTRFDRRHHAVDAAVITFITPTIATILAQRDSMRDSQNLLREPAQWKEFTGLEEKDRFMWTRWKIQMEKLSVLLNEALANDRIVVMSNLRLRLGNGSAHEDTIGKLTKLHVGDALSVAMIDRAASEALWCALTRHPDFDPKEGLPADPSRQIRIHGTRLGATDEIGFFPVNAGCIALNGGYVELGSSFHHARIYKITSGKKPVYAMMRVYTVDLLPYRNQDLFTAEIKPQSMTMRQCEPKLRKAIAEGNAEYLGWLVVDDELLIDPTPFSDGQVGNAQQELGPIRRWRIDGFPLNSKFRLRPIQMSTEGLDLKAPSGVKKDRFGPDVRKIVDSPGWRPAVNKLFSSGKVTVIRRDALGRPRLESAAHLPISWKVE

SEQ ID NO: 564 - protein, 1167 aa, Mycoplasma hyosynoviae
MIVEIMEKEKITIGLDLGVGSVGWSIIDSNNKVVDLGSRLFDEPNLALDRRAFRSRRRMIRRKAYRNNKFYKLVLKYPDIFNVKTKEELQQIIKNVNHKYPNILDLKVKALENEVTSGESIAILHDYLENRGYFYEIIEEKEEKKKKDIEKTNQLPSIQQKNFFDKYKVINDVFSKEVTQFSNKEWIKEIEVFSKNQSYLSAEFNEAFMNIFSACRDFALGPGSLHSPSEYGVYNKNPETGKVEQKYNFIWDKTIGKCSFFPEENRAPKNTPSAQLFNLLNQLNNLRIIGDDEWRLTTEDKKAILNSLLSSFKEGKKSSKLTLKNKVLLNCVKDKENPIFSGYDTDKNGDHKFVEIASFGVLINALLDENNANQEILNNINFDQMQEWLPIFDKLCEILVYYPDVNKRISQILELDLLKNNWNMNKEQLEKFANKLSHSFIGATTHSLSLRAINLFLPKMLNTNSNYESCKYEYLHNLNIKNQEQPPQKQTKYISAAFLEKEILPPSVKSTMRESIAIVNAIKKQYANKYEIENIVIEMAREKNSSEKKKKILKLQEKNKEKKKLCDEELKKHGYSQEAIDKVNVHTSLKIKLWIEQQHIDPYIGKEIDFDKMVKDNSFTEIDHIIPYSMSADDSWANKVLVLRTSNQTKGRKIPYDYFETNQLPNWGWNEYVAWCNDKILNGPKELLPKKELRIKKFNNLTLTNFDSNNLGFLARNLNDTRYMSKLFRDKLIEYSKANNNAFKVYTLNGNITSYVRKIIDNTKDAPYMKKDRNDFSHHAYDATILALISKNAYWLFKKIDDQNSRYMIQTNSDGKVYKLDILTGELTSFKNNKSDNKIFDIYAIANMVYEKTKDINREDIKFSRKQVVKTNGELFNKTKYGYKEDKENQEIIYKIEKINLITEELKKLKDYFGNEANETKVQSLLIYQERPEQYKMLNNIYLEFIAKNSKQNPFITYMNELLEKCEIFGIDKKYVEITKRNKIILFNQENKIIQVVGNLKYISDERKKINVFLDEKNKCFQDSFKPFGALVYKDKSKKKIFKEVAINAKIIKFQDKKIDWYDESNYFEDNLRKIKAFKNIDVNANIEQVILIGDKWINDDHQIVYINGVGDTNNSIEYNFIDKNVLIEKNDKSEKKRNKLSIGEFLKIFRPININNLGRILNIKKK

SEQ ID NO: 565 - protein, 1097 aa, Mesorhizobium sp. LC103
MGKGDILFSFDIGTNSIGWCVFALSDNGDPCRILDANARIFADGREPKSGNSLAEGRRAARAMARRRDRYKRRRKAVLRTLTEYGLMPADPKARQALVAKTGDRGPKSEEALADVYSLRARALMEKLPLHHIGRALFHLNQRRGFKSNRKTDRKSNEKGAIETGVNRLLEEMRDTGAPTLGAYLAKRRSDGRPVRVRAGASEQEAEDGKPAKTAYDFYPVRRLLEEEFDAIWEKQYSYHPEVLTEERRGHLFRVMFHQRPLKPAIVGRCSFNSAETRLAKAHPLFQEFRLYKEVNELEVVMPDQSHRKLTLPERDRLVLKLRGQRKATYAALRKELRLRDLRFNKETENRTDMMGDEVTAALADKAVFGNRWSGFSTDEKWRIVERLREEEDPFALHEWLVSEHGLSDAEAEQAAKVHLPDGYGRLGPTAVSTMLEELKADVITEADAARLAGYDHSLARADEDGLDRLPKYQEVLERRIPPGTNDPDDPYDIAKGRITNPTVHIALNQFRHVVNALARRFGKPDQIAIELARELKLNDRQKDEVNRVIGRNTRAAALRSQKLRDIGQKDNGYNRALLKLWEELNPDKPEDRVCVYTGRPICISMLFSGEVDVDHILPWSRTMDDSQANRILCVVEANRVKANRAPAEVAEWGGRYDEILERAARLPRNKRWRFARDAMEKYKENEGFLARQLTDTQYLSRLAREYAEALYPTEEPDRLGELRRRNHVRVIPGRLTEMLRRGWGLNALLPDHNFGAGQAKNRKDHRHHAIDAAVVGVTTRGLLQRISTEAGLREKLALEETIADIPMPWPGFREELKAAIDRAVVSHKPDHGTLPKPGEHGRTAGQLHNDTAYGITGETDARGNPIVVRRKPFLSLTDKDIPSIRDTELRGRVYSATSGLSGRELSAALDYFRKTDKQFRGIRHVRVTESLSVIPIRDRDGNIYKGYKGDANFRYDVWELPDGKWKADVVTMFDAHRPDRAAEERRPHPAARKVLSLKQNDMVACEHPKDGYTIGRVVKFNTAGQIYFAAHNEGGSLKARDADRADPFKYFSKSASGLKEIAARQVRIDATGQVLDPGPQDRESRLARNKRLERERA

SEQ ID NO: 566 - protein, 1110 aa, Sphingobium sp. C100
MTARTHKIWRLGADLGANSLGWAAIELSAPVDGKPIAILHAGSRIFSDGRDPKSGASLAVDRRDARAMRRRRDRLQQRQRALIKYLIADGLFPADENERKAMATIDPYAVRARALDEALTLPEVGRALFHLNQRRGFKSNRKADRKADEDAGKIAIGIDRTRDAIRQAEEEAGAEPGSWTYGKWLYERRASATDANAIPSVRTRLRPETDEHAKGDGYDFYPGRALMEAEFAAIWEAQAAHHPDALTNEVHDRLHEIIFYQRPLKAPQIGVCTLIRGDQRLPKAHPLFQKRRLLEELNALTIVRPGEMAQRLTREERDTLFLKLKDKAKVSFVSLRKTLKLDPDARFNKESENRSDLKGDEVAAAMGAKTRFGNRWVHLSIEEQWDVIARLEEVESDAEDAACRAWLAATFDLTPEQIRAVTNAPLPPGYSRFGKVATQRLIDALRDGEKDGRVLVYSEAVAAAGLGHHSDLRTGEIFEDAQGRPQLPYYGVALERHIMPGTGNPDHSDEMRIGRLTNPTVHIGLNQLRRIVNTLIRAYGPPAEIAIELARELKLTDDDKKRINKENNENRLAAEKRSEKLLTIGRPDTGANRALLKLWEELNPANVLDRRCIYTGTQISVDMLFSAAVEVDHILPFTATLDDSNGNKIVCMREANRTKRKQSPYEAWGHTDRWEEIAARAAQLPRNKRWRFEPDAMEKFKDESGFQARHLVDTQYLARLSREYLETLYPGSGEGSSHIWVSPGRLTEMVRRKLGLNDLLPDHNFGGGADQAKNRLDHRHHAIDAVVVAIVDRSMLTEISRVSGLEGAEGRERIIIPPPWDEFRNDLRTAVNAITVSHRTDHGTISKAGLPKGKDATAGRLHNDTAYGFTGETDAKGNSIVVRRVPLASFKKLADLDRIRDTDLKAALYQHLEGLEGKAFEKAVMDFPNLEWHPFGNVRRVRVTEVLSVIPISDQNGRIYKGYKGDSNYRYDVWELPGGKWEAEVVSTFDAHQPDWVSKIRSRSPTARKVLSLQQNDLIAVERAHETRELMRVVKFRQNGEITFAPPQEAGSLKRRDATPNEDDPFKYFAVAASSLQKAKARQVRIDELGRVLDPGFPARTARRKTRKST

SEQ ID NO: 567 - protein, 1419 aa, Chryseobacterium sp. CF314
MMIKNILGLDLGTNSIGWALIKQNFENKYGEILGMGSRIIPMSQDVLGEFGKGNSVSQTAARTGYRGVRRLRERFLLRRERLHRVLNVLNFLPEHYASQIDFEKRFGKFKYETEPKLAYNNDGFFFKNSFDEMLGDFKDHQFHLLENGRKVPYDWTIYYLRKKALSQKIEKEELAWILLNFNQKRGYYQLRGEDFEEEKDRVFVRLKVDRVVDSGENIKGKILYDVYFENGWKYEKQIVKTEDWIGRTKEFIVTESILKNGDTKRTFKAVDSEKDWIAIKTKTEQEIDKSHKTVGAYIYEALLQNPKQKIKGKLVRTIERKFYREELKKILERQKEFHPELQSDDLYNDCIRELYRNNEAHQITLSKKDFVHLLLNDLIFYQRPLRSQKSSVSNCTLEFRKYKDENGVEHAQYLKTIPKSNPYYQEFRVWQWMFNLNIYRKDDDTNVTKEFLSSTEDYETLFEFLNNRKEVDQKALLRHFKLNEKTHRWNYVEDKKYPCNETKTMISTRLEKVENYPSDFLTREMEQNIWHIIYSVNDKIEYEKALKSFAHKNNLDENSFFEAFKKFPPFKSEYGSFSEKAIKKLLPLLRLGKYWNWESIDRKSQGRIEKIITGEFDGNIKDKVREKAIHLTAENDFQGLQLWLAQYIVYGRHSEASMIGKWNSADDLEEFLKGFKQHSLRNPIVEQVITETLRVVKDIWLKYGNGAKDFFSEIHIELGREMKQTKDERVDATKRITENENTNLRIKALLAEMMNDNSVENIRPYSPMQQEILKIYEDGILKSDIEIDDDILKISKTAQPSSSDLKRYKLWLEQRYKSPYTGQIIPLNKLFTSEYEIEHIIPQSRYFDDSFSNKIICESAVNKLKDNYIGLGFIKQFGGMIVECGFGKSVEIFKAEEYEDFVKKHYANNRSKRNKLLLEEIPEKMIDRQLNDTRHISKYISGVLSNIVRQEDGTDEGVNSKNIVPGNGKITTQLKQDWGLNDVWNELILPRFERMNQLTNSTDFTSWNKNHQKFLPTVPIEFSKGFSKKRIDHRHHAMDALVIACATKDHINLLNNQSAKSDTKRYDLKRKLMKFERVVYSHSKTGEKIEKEVPKQFLKPWDNFTVDAKNKMETIIVSFKQNLRVINKATNHYEKWIEKDGIKRKELIKQEGTNWAIRKPMHKETVSGKVDLPGIKIPKGKILTATRKSLDTSFDLKTINSITDTGIQKILKNYLEFKGSSELAFSPEGIEDMNKNIEKFNDGKPHQSINKVRIFELGSKFSVGQTGNKKDKYVEAAKGTNLFFAVYEDKNGKRSYETIPLNEVIERQKQGLDSVSFKNKEDFLLCPNDLVYVPSEDELENIYNIDFKNLTTEKTGNIYKVVSFSGNQIFFIRQDIAISIVNKAEFSTLNKMERAIDGSMIKENCIKLKIDRLGNIAKI

SEQ ID NO: 568 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 569 - protein, 1348 aa, Leptotrichia sp. oral taxon 215
MKKFEDYYLGLDLGTSSIGWAVTNEKYDILRFNKKFMWGTHLFDMGNTASERRIFRTSRRRLKRKKNRIELLQTLFSAEMSKKDFGFFQRLKESQYFIEDKTFKNKNTLFMDENYTDQDYHMEYPTIYHLRKALIDNEESAFEIRKLYLAISHILSHRGHFLFEGELSDNLDFDDIFNEFVKYLNEELNIDFKIKSDVSLQAIKEILTDKMLNRTKKKEKLSELLEEEKNKIYQEIWKLLVGNEAKMSTIFDDKEYEEAKIAFSKGNYDEKEEEYESILGEKILFVQKAKAIYDWMLLQNILKEDKYLSYSKVKLYNEHKKDLKILKDVLKNLDKKIYKEIFSENGLYEEYLRIEKKKIGSKEEKTKDILYNRLKKIFENRDNMAIEDILNKIELDSFLPKQKIKDNGVIPRQVHQKELEIILKNAEKYFKWLIEKDETGLSVSEKIMKIFKFKIPYYVGPLNSKSPFAWIERKEYGKILPWNFENMVDMSKTAEKFIKRMTNKCTYLPEKDVIPKNSLLYTKYMVLNELNNLKIRGEKIKVELKQKIYTELFQKNKKIGMKTLIEFLKSQNIVVTKVEITGIDGTFNTSLGSYIDMKKIFGEEKIVKDSYKKMIEDIILWITLYGEEKKLIKSKIEEKYPEKVTPEEMKLILKLKYRDWSRLSKEFLTEIETMDEETGELISIIEMLWRKNENIMELLSYKYDFSNRIKEYNGINEKEKNITYEDLVKDLQISPSVKKMIWRALVIVKEIKKVTNKSPKKVFIEMARDTQTEKKRTEKRKDKLLELYKNIKNDDSIKELEKNLKDKTNDDLKSKKLYLYYLQLGRCMYSGEVIRLEDLMNDNLYDIDHIYPQSKIKDDSFDNTVLVKKQINADKTNEYPIDKSIQNKCKAFWTSLKERGLMSNTKYERLTRTEGFSDDELAGFISRQIVETRQATKVLADLLKVIFGSDTRIVYVKAGLTSDFRQKFGIYKFRELNDYHHAHDGYLNIVTGNIYNTLFTDNPYNFIKDRKKDNRTYNLNKVFERENDVWNPDVMLSKIERYIYKIRPLFTRASYEQKGGFSDQNISSEKDKLRPLKSSGVLSNIKYGGYDKIKNSYFFIVEYTEKKKRVRSIETLPIYIKKSISTKEDLEKYCKEELKLQEPKVLVSKLNYKSLIYSNGHEYYINSKTADSITIQNGIQIILTKENYETYRKIYKNLEYLKLIYKDEKIREEKILEKIPKILKNNKNDRDLSEDEISEKFWKLYKEIFEKIKIGIFSKFKSTLPIYIEDCKKLKDFTTLNNYAKSRFIQEILKCLNSQQGEFDTKYTHNYSKKYNTKLSKSKILENDFYIINQSPTGLFEKKVFLDK

SEQ ID NO: 570 - protein, 1345 aa, Streptococcus mutans; identical to SEQ ID NO: 159

SEQ ID NO: 571 - protein, 1128 aa, Roseburia intestinalis
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRIGCSWSEKGYILTPRNKAENYQHTMLRAMLVEEVKEIFSSQRRLGNKKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTANKPYSEWRTMEDKDFLFSLYSRDLVHIKSKKGIPIKNVDGSLGESKEVYAYYIGADISGAKIEGKAHDSRYTFRGIGVQKLELIEKCQVDILGHISTVKNEKRMGFS

SEQ ID NO: 572 - protein, 1395 aa, Veillonella sp. 6_1_27
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYTDQDYYKEYPTIYHLRVALMKSGTDDIRKLFLAVHHILKYRGNFLYEGATFDSNASTLDDVLKQALENITFNCFDSSAAIGSIGQILMELGKTKSDKAKAIERLVDTYIITDEVDTSGKTQKEQVKEDKKRLKSFANLVLGLSASLTDLFGSVEDLDEDLKKLQIIGDTYDERRDDLAKVWGDEIHIIDDCKSVYDAIILMSIKEPGLTISESKVKAFKKHKDDLAILKSLLKSDRSIYNTMFKVDEKGLHNYVHYIKQGRTEETSCNREDFYKYTKKVVEGLPDSKDKEYILSEIELQTLLPLQRIKDNGVIPYQLHLEELKVILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKAVKEHLIEAVFKQDHKKMTKNRIEQFLKDNNYIPEKHKPEITGLDGEIKNDLASYRDMVRILGNNFDLSMAEEIITDITIFGESKKMLRETLRNKFSSRLDDEAIKKLSKLRYRDWGRLSRKLLNVIEGCDKAGDGTPETIIILMRNFSYNLMELLGDKFSFMERIQEINAKLIEGQIVNPHDIIDDLALSPAVKRAVWQALRIVDEIVHIKKTLPARIFVEVTRSNKAEKKKKDSRQKRLSDLYAAIKKDDALLSGLTNEEFGGLKSGLAKYDDAALRSKKLYLYYTQMGRCAYTGEVIDLSQLNTDNYDIDHIYPRSLTKDDSFDNLVLCKRTANAQKSDTYPISKEIQKAQKAFWIFLKQQGLISERKYERLTRITPLTADDLSGFIARQLVETNQSVKAATTLLRRLYPGVDVVFVKAENVTDFRHDNDFIKVRSLNHHHHAKDAYLNIVVGNVYHERFTRNFRAFFKKNGANRTYNLAKMFNYDVKCTNAKDGKAWAVKTSMDTVKKMMDSNDVRVTKRVYEQKGQLSDINLTKASKVKADIYLPIKANDPIMSQNMKYGGYSDIKNAYYTIIEYSDKKNNSIKAFIPIPIFIATKTLTKQALLEYIKTVLPKANNLRIIYKKVYNDQLLKIDGFNYYLGGRSNDRFCIDNAIQLIVPLEIQFYIKLVEKFTAIISENKNIALKASSVKSRNPINNQVENITLEYTQKLFDYLVSKFNELIYLKMRGNKLTDVNNIGRKQFIKLSLEERCKALAELLNIFTNMNKKLSLSTINVSASRKVVNFKISSLDEFKIVNESITGLYSHEITIV

SEQ ID NO: 573 - protein, 1179 aa, Sphaerochaeta globosa
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 574 - protein, 1645 aa, Francisella philomiragia
MSIKILPIAIDLGAKNTGVFSAFYDKGLKLESLITKHGMVYELSKDSYTLLMTSRTAKRHQRRGLDRKQLVKRLFKLIWTEKLKLDWDKDTQQTVSFLLNRRGFSFLEEKHDASYFEKFPIEAIELLPQQLRLGIDSEENYDLNSKILETLENDTFKDVFEEIESNIKQAKKNIVKANVINIIKSAIDDKVRMGEIKPTKQNKFNDLKKVSLWIVEDIFDSTTSAYIERVDNYSKNIFNYLNSLSSDQLEILKTNLPIIDLNEHKNSVWNFNISNFNLDNEKLVEKLEVGDVSAHLHHLGYALQNIKKELDEGSRHRSKYFEEVASVLLEQNHKEGYLRNFCQNLHIGKYKNLNVKKLVNLIGNLSNLELKPLRKYFNDKAHAKADYWDEKRFAETYCRWILGEWRVGVKDKDKKDDAKYSYKDLCNELKLEVGTTQEVKANKSKGSVVEFLLELDPCRTIPPYQDNNNRKPPKCQSLILNPKYLDKKYPEWQDYLKQLKQLDSVQKYLEEFEQDLKGLKTSKDQPYFVGTKSENKQIASGQRDQKDLDARVLQFIFDRVKANDDLLLNEIYSQAKKAKQNASNESEIARAVQNLDKTLAKSKLPSALKTQHIKGIFEQGTLLHLVCKYFKARQRARDSRLYIMPEYRYDKNLDKYNNTGRFDDDNQLLTYCNHKPRQKRYQLLNDLAGVLQVSNGQLLSVEKWFRQAQPAETTKSQDEQIFEWLKAFKIASYCKAAVDVQKQYRGTLKNAVQTAIFKQRLETIKKNKKASQDEKALLEKYKNAKPLTADEKNLVKLVDNISKASQKIGENLGLDNKQVSKFNSIYSFAQIQQIAFAERNGNANTCAVCSADNAHRMQISNDSAKAQRLPAIPTRIVDGAVKKMATILARNIVDDNWDNIKKTLENKEELHIPIITESNAFEFEPNLAEIKGTKKKDRISSQELFAKKEERIKKASNEISAYSGASLGGETELDHIIPRSHKKYGTLNDEANLICVTRDDNQKRGNTPYYLSNLADKYKLKLFGTADNQEIEKYIADKIWDSERQDFKFGNYRSFINLSQEEQIAFRHALFLADENPIKQAVIKAIDNRNRAFVNGTQRYFAEVLANNIYLRAKKENLATNKLSFDYFGVETTNSNGRGIADIRKLYEAIDSDIEAYAKGDKPQDSYSHLIDAMIAFCVAADEHKNDGSIGLEIDETYSLYPLDENTGEVFKEDIFSQIKVADSEFRETKLARRKAYTVETNIRQEIQSKGDFKKSIPYKIHIDSLSAERFFPLLQISQDKWKYGFTLDNSVDIPKKDIELIQEFLTKSKEYKDYTVWIVNKTQAQEFLINIGYVGADKQQEKIAKLLDKLSYTTIKKEITSILAKANKTPDTVGDALDVIDELVFKTDKKNKLINFVKSEILLPVYNDWIMLKKAMQKADMNQNLHDFLSMYFITTNLKNKHQKVRKNFSLPVVSTIGTIRIRRKSWDGSNIYQVTGDESLAKYGFDGTVRPKTILSRNSVPIKYYNGKEKEVLIEPLSWIILDIDDLTDTSIIRAQIKNRSAGQVSIKVELSSLDNICLKEDSWSGNIIYAGDKDKPNTIKGDKFYIKKEDFYWLKDFSLMFDSGKTKASLSIDKIGNSYILEFVSSKGKKEKQWLKNETPNS

SEQ ID NO: 575 - protein, 1355 aa, Leuconostoc gelidum
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 576 - protein, 1437 aa, Capnocytophaga sp. CM59
MKYIKYILGLDIGSNSIGWALIQLDLLQKTKRIIATGSRIIPMDQKVLSDFGKGITISPTAQRTSYRNARHCRERHLLRRERLHRVLHILGFLPTHYDKQIDFSKRYGKFVDNTEPKIAYNERKFLFMDSFQEMLADFKIHQPDLFYTKKNGEESKIPYDWTIYYLRKKALSRKISKEELAWIILNFNQKRGYYQLREEEEENKENDFEIISSKIISVIKKDKDKKYNKYWYDIILENGLVYQAAFYNDFVYNWINQDREFIIERISLKNGTEKVKLSYLPTFDEIDKMDKKEQDKYYKKIKIKTENSIGNKTVGCYIYDHILQNPNEKIKGKLVRTIERKYYKEELKAILEKQVALQPELFTDQLFADCIRELYSKNEAQQRNLAARDFVHLFVEDIIFYQRSLRRQKSTLANCSLESRSYIDKDSHTRKEAPLKVCPKSNPYYQEFRVLQWLQNLKIYEIDTDQEVTHEFIKTLEDKQQFFDFLMNQKEIDCEELLKYFLNQTYPNAREKALKSELKKWKDTYRWNYVYDIGEKSSKKYPMNETRYELKRHLEKVANLPDDFLSSEVEYLLWHLIYSVKDKVAYEKGLKTFAQKHHLDKDSFVESFKKFKPYPSEYGSFSEKAIRKLLPLMRFGSYWDFNHIDKNTQKRIEDLITGVENEEIRTILREKAEKYQLEKETDFQDLPLWLAQYIVYNRHAEASSLEKWTSVNDLETYLNEFKQYSLRNPIVEQVVMETLRVVRDIWQQYGQGQASFFDEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSTENKTIKIFTEEQYRTFIKEHYSNNPEKTKKLLLEEIPEKMVARQMNDTCYISKFISEILSKIVRSDEQDEGVHSKNVILCTGKITSALKQDWGVNDVWNDLILPRFERMNDLTQSTLFTTYNEKYQKYLPTVPMEYSNGFQKKRIDHRHHAMDAIIIACATREHINYINNQHALEKGKDKKEKQKEHDKLREKLCIKKDNKGSEENYSWIFKKPWDTFTQEVQAALEGIVVSFKQNLRVINKATNYYERWVEENGKYIKKMVKQEGTNWAIRKPLHEETISGKIYLDREEITKNDILTATRKTVDSSFDEKRIKKITDTGIQKILLNYLKYKGSPEIAFSPEGLEELNKNLSIYNDGKPHKPIYKVRIYEKGSGRFALGEKGRKYKKYVQGAPNLYFGIYQGANKRSFATIPLNEVIERQKQGRPSIPEYNEKGDPLLFSLSPNDLVYVPVEGEIIEDIDFQNLSKEQKERIYNVNDFSSTCYFTPNRIAKAIFPKEVDLQRKGDKLPGSYDTKTASLEGIQIKEVCIKLKIDRLGNISKA

SEQ ID NO: 577 - protein, 1535 aa, Flavobacterium columnare
MTKILGLDLGTNSIGWAIRDTENEGINQILDKGARIFSEGVKSENGKEISRAAERTAYRSARKIKYRRKLRKYETLKVLSINGMCPLSVEEVEQWKKSGFKEYPLNPEFLDWLRTNEDKNINPYLFRDKASKQKVTLFELGRALYHIAQRRGFLSNRLDQSAEGVFEEHNPQIQNLIEDLDSSNTILNELKEYYINLGIIDETEKSGFKKDLDEGEKKLKSLYNSLVAITKKNANDIETCKQELIARLNKKEDLGKVKGKIKDISQAMLDRNFKTLGQYFFSLYNKERIRNQYTSREEHYLEEFIIICQTQGIEGINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKSDFNFEVLAKELVEKGASFGYYKSSKKNEFFYWFNYKPTDSVSACVVSASLENAIGKDWKIKTFEYQTRNTEKNEVTKSVDYKDLWHLLSVATSDTYLYDFAIEKLKLEPKNAKAFSKTKLKKDFASLSLAAIAKILPYLKQGLLYSHAVFMANIENIVDADIWKDEEQQKFIQSKIVELVDNYIVEKSKLELINGLLKIYNTEDKEGRKVYYSKEAESLFEADLRKKLVPFYKANIIIEEHEQEIIFQDLFPILMDQLKKQEFIKIGRLDKQIEAFLEGENEEGQIFCNHTDKLKKLYHPSDIEVFKKKTIKDEWGNEKVVLGSPLTTSIKNPMAMRALHQLRKVLNTLIANDQIDEDTRIHIEMARELNDANKRKGIQDFQNENKKFREEAIKEIKKLYLEECHKDVNPTEDDILRYQLWLEQGKCEIYEEGNNISICDIIGSNPSYDIEHTIPRSISQDNSQMNKTLCSLKFNRSIKKQKMPVELSNYNDILPRIAHWKKEAEELTRQIETISRSIKSAATKVAKDKNIRKRHYLTLKRDYILGKYERFTWEEPKVGFKNSQIPDTGIITKYAQAYLKSYFKRVESVKGGAVAEFRKLWGIQESFIDENWWKHYKDKDRDKHTHHTIDAITIACMPKDKYDLLAHAWRLEDEQDKKAAKVLIEQAKPWKTFKEDIEKIETEILVSHFTPDNVKKQSKSIIKNRGKKVYVLKNELPVNFKNKIEGKDYFKLKFDSKILYKIPKKKEKQTDTFYEELPKNYLNGVEGKDYFKINTTGKTFYKIPIFNQGDTIRGSLHQETTYGAIKLPDIDIETKKPLHTDKGGFILKKDIKGNEIVFFVVRKEISKISENDVQNIVDNVVRKKIENAIANSLITFKIVKKKKVAVIKEGVTIWMREPNIEKGIEGIPIKKVRIITNSVKNPIEIKVHSPLSKSRHKHKQKVYGQNDENYAMALYELDGKREFELINNFNLAKLLKQSQSYYPLHKEKEIKGKKILVPIEKRNNKDVILKRGQQVVFYDKTVENPKDISEIIDFRERIYIIEGLTIQRQKDKKTSKVNEYGIIQLRHFKEARKSEEISKDNFKPDGEFKINENKPTRKMNHNQFTAFVEGIDFKVLPSGKFQKI

SEQ ID NO: 578 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 579 - protein, 1368 aa, Firmicutes bacterium M10-2
MKYESEEYYIGLDMGTSSVGWAVTDPHYHLIRKKGKDLWGARLFEKANTAQERRTNRINRRRNQRRKQRIAFIREAFRKEVEKVDVNFFRRLDESQLYLEDKSIKEPYLLFNDLNYTDKDFYHQYPTVFHLITDLLTSDRKFDIREIYIAVSSLYNHRGNFLNKSLGNETQDEDLVFKNLDEAFSACGMNWNTKAENIEVVKQILCDRSLNKKEKQDQLAHCLEINKKTEKEKIEFLKLLTGGKADSKKMFPQYHYERDEKLSFAFADENGDENWEETLNAIEERLTSDEYGLILALKSVYDWSILADLMKNEKTGETYPYLSMARKDSYEKHKADLRLLKSVIKRLIPNEYNHFFRQYDGKGKTYTNYIGSVQYHEKRHRFKHITTKEFYDGLKKLLKPYSEDEEIKQILQDIESETFLPKQITNMNGVIPNQVHAKELKVILEKASQHYDFLNETNESGLTVKEQIMQMFTFQIPYYVGPLANLNGKGNGWAVRYVGKERTKVYPWNMDEVIDEKETADQFIKRMISTCTYLGDEYVLPKSSILYEKFAVLNELNSLKINGQPVSVDLKQKIYRDLFTKGKRVTQKGLLLYLKREGVISKSEETILSGFDIDFKNTLSSYRKFCEVFATNELNDEQIRMAEDIIEWLTVFGDSKKFVREKIHGNYPQITANQLKRILSFNFKDWGKLSKQFLELEGEDRETGKSCSLIQALWDTNNNLNQLLSSRFTYKENLEKKRKKIEMDLFEFTHEDLDDLYISAPVKRMIWQALKIMKDIVIVMKESPTKLFIEMTRNNENEKTRTVSRKNKLVDLYKKIKGESRDWIKELERYEEKDFRSKKLYLYYTQMGKSAYSGEPIDMDKLFDKNVYDIDHIYPKSKVKDDSLLNNCVLVKRKENMDKGNNFPIDPDIQTKQEHLWKFWLEKGLITQEKFNRLTRKKPFTNDELADFVNRQLVETGQATKTIADLFKMTFPNSDIVYVKAGNVTDFRQYIEVYKCREVNNLHHAYDAYLNVVVGNVYDTKFTKNPMNYIKEQRKENSNERYHMDKIFEFPVIRNGKEAWITKKDESINIVRKTLARKTPLVTKRNFEANGTIAKATIYPKGNVKDQGYLPRKTSIPALRDMKKYGGVTSIQIAYFFLVEHEVKKKRIRTIECVPIYRKEELKTKEQLERYCREELKLINPSIRLEKIKPYSLLKMNGNFFYITGKTNDRFSLANAMELYVDKVSENHIRDLVKYKNCGYFNVDDKEARKRNERLYTILTKKHLTVFKGSPKPMGEKLQQYQQLFLELEVSKQVYVLLQILQLTATNVKTKADLTAIGGKANEGTMDISKNLENVIKNQIKKGLVPELMLINQSPTGLFESEIDLLTI

SEQ ID NO: 580 - protein, 1068 aa, Sedimenticola thiotaurini
MPKSAKPQQAYTLGLDIGIASVGAALLGQQHIIGLHVRTFDRAETAKEGEPLNKIRRDARLTRRRLQRRAHRLLRLRRLFKRHNLIPDTDTSTFISGQSPWELRAQGLDRQLTSAEWTTVLYHIVKHRGFHSNRKSEVKTDEKAGQMLSGVNQNQALLKQSGLRTMGELAARHEAFREAKRNKKGAYNHTFSRHDLEDELHLLFSRQRELGNPYATPELEDAVHTLLMQRRPALSGTNLLKMVGHCTLEPDEFRAPKASYTAERFIWLTKLNNLRVSGSGETRPLNESERQALLSKPFSQSKLTYKQVRKILELPDNIRFVGLHYHPAQDNGKSPENRVFFEAKAFHALRNVYKKAGLNLEWQRDSQNPEKLDNITYALTVFKEDKEAKQWLIEKGVEASVIEAVLNESFSEFVRLSIKALRKIIPHMEIGHRYDEAVKLAGYSHHSHLPQPSKTPYIPRFSKQSIANPVVSRALNQARKLVNAIVREYGPPDAVHIELARDLNKPFDERRKIEKDQEKYQKDKARDIETFQENFGFTPKGLQLTKWRLYREQSGKCAYSLKPLDINRLFEDGYVEIDHALPYSRSFNDGMNNKVLTLTTENRNKGNQTPYEYLDGASNSAQWRNFVAWVNSNKSYRASKQRNLLRKDFAAQAATEFRERHLTDTRYIAREFKRMVETHLKLNKPNQRCVVVSGQLTAYLRARWGLIKVRENGDLHHALDAAVVAACSHAMVKRLADYSRRGELQYARGHHFDPETGEIIDINALRKLDDHFPQPWTDFRRELLAWLSPDPAQQLKNLAYYTDERLKQVKPIRVSRAPTRRGLGAAHQETIRSAKYLGENRSTVKTPLEKLKLKDIPNIVGYEDPRNHQLIQAISQRLTEHGDDGKKAFKEPLYKPGNNKSTAPVVRSVKLFTVQKSGIPVRGGIANNGNMVRVDIFTKKERYFAVPVYVSDAARNELPNKAVARGKDGWIDIDDSFSFLFSLYPNDWVSVVVKPHEAPCEGYYAGLDISTGAIHIWAHDRNRSVGKNGLMRSIGIKTAHSVEKYHVDLLGNLYRVVHETRKPLRAGK

SEQ ID NO: 581 - protein, 1494 aa, Prevotella pleuritidis
MKNILGLDLGTNSIGWALIDNESHRIIKSGSRIIPMDAATMGDYEKGNLKSADWKRTSFRGMRRLYERAKLRRERLLRVLNILGFLPEEFRRQIDFEHHPGQFIDGKEPLIAYHHDENGQRVFSYMSAFEEMLTDFRATQSELVRDGRRVPYDWTIYYLRHKALTQPVTKEELAWIILNFNTKRGYYQLRSESEEVTTNKNEEYAELKVVSVEKTGEDKKRAGYYWYTITYDNEAEQKITSTIPPRQIGDKVELIVTTARDKAGEIKKSVRSPKEDDWTLMKKRTEHNIEEEECTVGSYIYQHILADPTVKVRGKLVHTIERKFYKKELKQILNKQKEFIPELQDASLYEACIKELYRNNEAHIQSIANKDFTDLFVNDIIFYQRPLKSKKSTISNCPYESYYYKNKETGELIRKPIKCIAKSNPLYQEFRLWQFVHNLRIYKKSEEVSGRLQTDVDVTDRFLTTPDDYAKLFSWLNDRKEIKQKELLRYEAFGLSKSYGDYRWNFVEDKPYPCNETLHEINRRMKSILSDKKLSSEAYQQLWHILYSIDDPIEIRKALTSFAQNQEINSDDFVNAFYQYVPEKTKSYGAYSEKAIKKLLPLMRRGSYWAIGNIDEKTHRRLDNIINGVADDSISTCTREKLNNLTDITMCQGMPLWQACYAVYDRHSEAADTTKWEQPDDIDTYLSTELKQHSLRNPIVETVISETLRVVRDIWKAYGRPEEIHVELGRNLKQDAKSRKQDAIRMAENEQTNLRIRALLQELSNPECGVENVRPHSPSQMELLKIYENEVLQSTDDIPEEISNIIKDLGKTDSKKRPSLSDITKYRLWLEQKYQSPYTGHIIPLSKLFTPAYQIEHVIPQSRYFDDSISNKVICEAEVNKEKDRMLGYEFIINKGGSIVKGSFGQQFKIFDKVQYEDFVKQRYAHNKTKMKKLLMDDIPDGFIQRQLNDSRYMSKKIISILSNIVREDGEKEATSKHIIVTSGAITDRLKKEWGIKDVWNDIIAPRFKRLNKLTDSNNYGMETEKEGRQYFQINVPTELSTGLIKKRIDHRHHAMDAIIIACTTRNHVNFLNNSTAASDQKDIRRDLQHTLCTKTKTDSNGNYVWRFNKPWDTFTQDTRQELEGIIVSFKQNLRIINKMSNYYQHYVDGRKTISRQNKGDGWAIRKSLHKATVSGKVNLKRSKTVGFKEALNDWSAIKDKTSKAILQKIIAQYKNYDPKTIFKYFKDRNFKVEGKDFSKLEVYYNTSDKEPMSAHRVNIDTTFDEKEIRSITDTGIQKIMLKHLHTYDDAQGKTHPEAAFSPEGIEKMNQNIRMLNGGKDHKPIFKVRKAEILGMKFAVGERGHKDKKWVEADKGTNLFFAIYESEENKRSYSSIPLNEAIDRLKRGENIADERDQNGNKLLFVLSPMDLVYVPDPDDAHIDEVKGNNNIFKMVSCTGTECYFVPETYANVICKGKELESKNKVESYDGINIKKSCYKITVDRLGKVRKIFKG

SEQ ID NO: 582 - protein, 1398 aa, Veillonella parvula; identical to SEQ ID NO: 167

SEQ ID NO: 583 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 584 - protein, 1426 aa, Niabella soli
MPRKNILGLDLGTTSIGFAKIIEDDDYQCSSVELIGVRVNPLTTDEQTNFEKGKPVSVNADRTLKRGMRRNLDRYQLRRDYLIEILRTHHIITADTKLAEDGKNTTHTTYALRALAATAEIPLEAFVRVLLAINKKRGYKSSRKAKNEDEGQLIDGMAIARRLYEESLTPGQFSYQLLKEGKKYLPDFYRSDLNTELNKVWNFQKQFYPEILTDEFKRHLEGKGQRATAVAFWGQHGFSMAENKGSREEKKLHAYKWRSEAAHKQLTKEEVAFVITEINNDLNKSSGYLGAISDRSKELFFNKQTVGQYLHQQLKENPHTRLKGQVFYRQDYLDEFETIWEMQAKFYSALTLELKEEVRDVVIFYQRKLKSQMGLISLCEFESKEIEIEKNGEKAKKRIGLRVAPKSSPLFQEFKIWQVLNNLEFRNKKTKEVFVPEMAAKQQLFDELNIKGNLLASEAIKILGYKTKDWEANYHTLEGNRTNKSLYDAWLKILELEGYDENLLKLSGSDDIDVSKIEKPALEIRQMVLAVFEVLGISGAILDFDAEADGKAFEQQPAYQLWHLLYSAEDDGKKYSQEDIFTYGHDNIGLKKKLCEKFGFRPEHTKILVNVVFSDDYGNLSSKAMRRIYPFIKELTYDKACAEAGYRHSAASLTKEEIAARPLQNRLDLLKKNELRSPVVEKILNQMVNVVNTLVDDENQNRKARGLSEDFHFDEIRIELARELKKNAKERAEMTTNINTAKQSHEKIIRILQTEFGVPNPSRNDIVRYKLYEELKNNGYKDLYTNTYISRDILFSKQIDVDHIIPQMSLFDDSFSNKTVVFRKDNQDKGNKTAYDYILGKYGEQALEEYISRITSLFELGKKNKEEGIGKAKFQKLQKRLVDIGDGFIERDLRESQYIAKKANNMLYAICRSVVSTSGEITARLREDWDLVNVMQEINLPKFRALGLTEMVEKKDGAQKERITDWTKRNDHRHHAMDALAIAFTRHSHIQYLNHLNARKDEANKWHPVVSKIEEKETVLIYDDLGNRKRKFKAPMPNFREVVKEHLENVLISHKAKNKVVTKNKNKIKTVRGEKVKTELTPRGQLHKETIYGRYRYYESKEEKIGPKFDAEMIGMVTNPQYKKLLLERLAANGNDPKKAFWGKNALNKNPLYVDEARQELLPEKILLRWLNDDYSIRKDVTPENLKDIKTIEKILDKGVKKILLKRLADFGNDPKKAFSDLDKNPIWQNEAKRIAIKRVTISGIKNAAPLHHKKDHLGNDILDEKGKQIPSSFVSTGNNHHVAIYRDAEGNLQERVVSLFDAVQLVNGGEPVIDKEYNKGIGWQFLFTMKQNEMFVFPDEKTGFNPREVDLLSSGNRKLISPNLFRVQKLASKNYFFRHHLETSVEEKKELKNIAYKPQLGLNALSNIVKVRINHIGEIVSVGEY

SEQ ID NO: 585 - protein, 1379 aa, Coprobacter secundus
MKQILGLDLGTTSIGWALVREAENKDEQSSIVRIGVRVNPLTSDEQKNFEQGKSITTNADRTLKRSMRRNLQRYKLRRDHLKDCLQKNGIITDKAVLSENGNYTTFQTYYLRAKAVNEKISLEEFARVLLMLNKKRGYKSSRKMKSADEGQLIDGMSVAKRLYNDNITPGQYVLSLLEEGRKYIPDFYRSDLLDELDKIWTFQQCFYPEILTPECRKLIAGKGKQATAKIFLGKYKIYTADNKSKDKRLQAYQWRVEALSGQLPIEVVAFVVCEINGAIQASSGYLGAISDRSKELYFEGLTVGQYLVKQLEKNPDTSLKNKVFYRQDYLNEFEKIWEKQAEYHTELTPQLKKEVRDIIIFYQRTLKSQKGLVGFCEFESRQIEVMIDGKLKKKTVGCRVCPKSSPLFQEYKIWHNLNNLKIVEKELGKSRFLNQDEKESLFQELNIKEKLSKTDILKLLCLKAKEFDLNFEKVEGNRTQAELFRAYQAIIEMSGNGDYDFSKMTSSEIQDTVTGVFRGLGYNTDILSFDAEKEEKTFDKQPMYLLWHLLYSYEGDSSDTGNKALITKIKKLCGFESEEYARILTDVTFQSEYGNLSTKAIRRILPFMKKGSEYSEACRHAGYRHSERSLTKEELDKKVYKDHLELLPRNSLRNPVVEKILNQMIHVVNTVVDTYGKPDEIRIELARELKKSAKERDEMTASINKTAAEHKKYCEVLQKEFGFTHVSRNDIIRYKLYLELENNGYKTLYSDTYIPREKLFSKEFDIEHIIPQSKLFDDSFSNKTLECRSVNIEKSNDTAYDYVLNKYGEQGILDYKNRIENLYKDSKISRTKYQKLMMKNSDISGNFIERELRDSQYIAKKAREILEELVKFVVPTTGSVTARLREDWQLVDVMQELNWKKYDKLGLTDVRYDKDGREIRYIKDWSKRNDHRHHAMDALTIAFTKRSIIQYLNNLNAKSDKSGSIYAIEQKELFRDKRGKLKFIPPMPCNIFRAEAKRHLENVLVSVKAKNKVVTPNINRSKGKNGINKKIQLTPRGQLHNETIYGSMKRYETKWEKIGSGFDERQIAKVANKKFREALLSRLAEFGNDPQKAFTGKNSLEKNPLYVDELHTQKVPEKVKIVTLENLYTIRKEITPDLKIDKVVDAGVRRVLQERLDEFDDDSKKAFSNLDENPIWLNGKKMKRVTIMGVSNAVPLHDKKDYKGNLVFDSKGRKQPVDFVNTGSNHHVAIYRDESGELQDIVVSFYEATTRSTLGIPVIDKEYKKAEGWNFLFSMKQNEYFVFPNEETGFNPKEIDLMNPDNYTTISPNLYRVQKFSKCMYGNSSVREYVFRHHLETSVNDSKGLKNIAYKNVKSLVYLEGIVKVRINHIGQIVSVGEY

SEQ ID NO: 586 - protein, 1338 aa, Streptococcus macacae
MTKPYSIGLDIGTNSVGWAVVTDGYKVPAKKMKVLGNTDKSHIKKNLLGALLFDSGNTAKDRRLKRTARRRYTRRRNRILYLQEIFAEEMAKADESFFQRLNESFLTNDDKEFDSHPIFGNKAEEEAHHHKFPTIFHLRKHLADSTEKSDLRLIYLALAHMIKFRGHFLIEGQLKAENTNVQTLFDDFVEVYDKTVEESHLSEISVSSILTEKISKSRRLENLIKYYPTEKKNTLFGNLIALSLGLQPNFKTNFKLSEDAKLQFSKDTYEEDLGELLGKIGDNYADLFISAKNLYDAILLSGILTIDDNTTKAPLSASMIKRYEEHQEDLAQLKKFIRQNLPDQYSEVFSDKTKDGYAGYIDGKTNQEAFYKYIKNMLSKTEGADYFLDKIDREDFLRKQRTFDNGSVPHQIHLQEMHAILRRQGEYYPFLKENQDKIEKILTFRIPYYVGPLARKGSRFAWAEYKADKKVTPWNFDDILDKEKSAEEFITRMTLNDLYLPEEKVLPKHSLVYETFNVYNELTKVKYVNEQGKAIFFDANMKQEIFDHVFKENRKVTKDKLLNYLNKEFEEFRIVNLTGLDKENKAFNSSLGTYHDLRKILDKSFLDDKVNEKIIEDIIQTLTLFEDREMIRQRLQKYSDIFTTQQLKKLERRHYTGWGRLSAKLINGIRDKQSNKTILGYLIDDGYSNRNFMQLINDDSLPFKEEIARAQVIGETDDLNQLVSDIAGSPAIKKGILQSLKIVDELVKVMGHNPANIVIEMARENQTTAKGRRSSQQRYKRLEEAIKNLDHDLNHKILKEHPTDNQALQNDRLFLYYLQNGRDMYTEDPLDINRLSDYDIDHIIPQSFIKDDSIDNKVLVSSAKNRGKSDNVPSEDVVNRMRPFWNKLLSCGLISQRKYSNLTKKELKPDDKAGFIKRQLVETRQITKHVAQILDARFNTKRDENKKVIRDVKIITLKSNLVSQFRKDFKFYKVREINDYHHAHDAYLNAVIGKALLDVYPQLEPEFVYGEYPHFHGYKENKATAKKFFYSNIMNFFKKDDIRTDENGEIVWKKDEHISNIKRVLSYPQVNIVKKVEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 587 - protein, 1049 aa, Mannheimia
MQLSKLNYILGLDLGIASVGWSVIEIDETEMPIRLIDVGVRTFERAEVPKTGESLALARRLARSTRRLIRRRAFRLLKAKRLLKNHQIVSADELSTLPNHCWELRVKGLDERLTCQEWAAVLLHLLKHRGYLSQRKSEAQNADKEMGALLSGVANNHKLLSENHYRTPAEIAVKKFALEEGHMRNQRGAYTHTFNRLDLLAEMRLLFQTQRELGSPYASGELEQEFCKLLMWQKPALSGDAILKMLGKCTLEPTEYKAAKNTYTAERFVWLTKLNNLRILENGSERALNADERALLLNQPYEKAKFTYEQARKLLQLNEAARFNSVRYGKENAEKSTLMEMKAYHAIRKAVETADSSAWATLKTQPLLLDEIGTAFSIYKTDEDIKTQLQGKLADNVIDVLLENLNFDKFIQLSLKALYKILPLMEQGLRYDEACSQIYGDHFGKKEQKNDRLLPQIPADEIRNPVVLRTLSQARKVINAVIRLYGSPARIHIETARELGKSYKDRKEIEKRQEQNRAEREKAVDKFKELFPNFIGEPKAKDILTMRLYEQQNGQCLYSGKSLDLHRLLEKGYVEIDHALPFSRTWDDSFNNKVLVLAGENQNKSNQTPFEWLGKDEQKWALFTARVNSCRFPYSKKQRILTKKLDDEGFIQRNLNDTRYIARFLVNFVNDNLHLTGKGKRRVFASNGQITAFLRGRWGLTKVREESDRHHALDAVVVACSTVSIQQKITRFVKYQEGNLQTAERIDRETGEIIPLHFPDPWAFFREEVMIRIFSEMPQEDLVIKLPDRPQANHEFVQPLFVSRMPTRKMSGQGHMETIKSAKRLDEGISVSKVPLTQLKLKDLENMVNRDREIALYEALKARLTEFKDDPAKAFAEPFYKKGGVQVKSVRVEQVQKSGVVVRNGNGVADNASMVRVDVFIKGGKYFLVPIYTWQVAKGILPDRAVIAYTPENEWELMDDSAQFQFSIYPNDLIKLTTKKAIFFGYYSGFNRLTGAINIKEHDLQISKGDKGVHLGLGVKLALSLEKYQVDELGKNIRPCRPTQRQNVR

SEQ ID NO: 588 - protein, 1429 aa, Parabacteroides johnsonii DSM 18315
MKKILGLDLGTSSIGWALVNEAENSDEVSSIIKLGVRVNPLTVDEMQNFEKGKSITTNADRTLKRSMRRNLQRYKLRRDALIELLKKVGFITDKTILSEQGNRTTFETYRLRAKAAEEEISLKELARVLLMINKKRGYKSSRKAKGEEEGALIDGMEIAKKLYDEDLTPGQLCLQLLESGKKFFPDFYRSDLQEEFNKIWDFQKQFNLFSFCDVAKEEVKGKNKSQTWAILAKYFVETKKVNVWNEHEAQTENREEVYKLVGLKRTVKGEELKKENYRWRVQALTEQLDLEKIAVVLQEINGQISASSGYLGAISDRSKVLYFNRQTVGQYQMAELNKNPNMSLRNMVFYRQDYLDEFNVIWEKQAEFHKELTPELKKEIRDIIIFYQRRLKSQKGLISFCEFENREVVVEKEGKKQTKIIGCKVIPRSHPLFQEFKIWQTLNNIEVFVGEKKGKRKKSNVSSDLFGDTEDALITEGRRFLYQEEKKILAKELSIKKGLTKAEILRLLFENPQELDINFKQIDGNQTGFALFSAYSNMIEKYGYEPLDFKKPAEDLISQLKTVFTDLGWNTDLLFIDLDKENKEWEKQPYFRLWHLLYSFEGDNTPTGNGKLIEKIMQLCGIEKEYAIELANVSLQDDYGSLSAKAIKKILLYLKEGNQYDMACEYAGYRHSKSSLTKEEIENKVLKDKLEILPKNSLRNPVVEKILNQMVNVINTVMEVYGRPDEIRVELARELKKSAKEREELTKAVAKNTREHEEIRKVLQSEFGMINVSRNDIIRYKLYEELKDNGYKTLYSNQYIPREKLFSKEIDIEHIIPQSRLFDDSLSNKTLEYKSINIEKGNKTAYDFVKEKYGEEGLQQYLNRCENLCKDKKAKLRKLKMELNEIPDGFIDRDLRNTQYIAKKALSMLTEICRRVVATTGSITDKLREDWQLVDVMKELNLPKYEALGLVEVYEDKDGRKIKRIKDWTKRNDHRHHAMDALTVAFTKDVFIQYFNNKNAAWESDSKEHTNIVGIKTRYFESGKAVPPIPLGQFRVEAKCHLENLLVSIKAKNKVVTTNVNCIKKKGGTYKNTQQTPRGQLHLETIYGSHNQYVTKIEKVNASFDAVKIATVSKQDYRNALLKRLEVFGNDPKKAFTGKNSLEKNPIYLDRAQTIQVPDKVQTVELETAYTIRKPVDPTLNVDKVVDKKIRLILEQRLKEYGGDAKKAFVNLDENPIWLNEEKGISIKRVTIRGISKAQALHDKKDKDGNFILDETGKRIPVDFVNTGNNHHVAIYRKPVLDKKGQVIFDDEGNPMYELDEDVVPFFEAVTRANLGIPIIDKDYKKSEGWQFLFSMKQNEYFVFPNEKTGFNPKEVDLLDPDNYAMISPNLFRVQKIGLNDYTFRHHLETTIQNDLKFITWIRCGKSGIKDIVKVRINHIGQIVSVGEY

SEQ ID NO: 589 - protein, 1127 aa, Streptococcus sp. I-G2
MNGLVLGLDIGIASVGVGILEKDSGKIIHANSRIFPAATADNNVERRTSRQARRLNRRKKHRSVRLHDLFEEYGLLTDFSKVSINLNPYQIRVQGLDKRLTNEELFIALKNIVKRRGISYLDDASEDGGAVSSDYGKAVEENRKLLAQQTPGQIQLDRFEKYGQVRGDFTVVENGEKRRLINVFSTSAYRKEAERILRKQQEFNNKITEGFIEDYLTILTGKRKYYHGPGNEKSRTDYGRYTTKKDSQGEYITLDNIFGILIGKCTFYPDEYRASKASYTAQEFNLLNDLNNLTVPTETKKLSVEQKKTIVEYAKTAKTLGASTLLKYIAKLIGVSVDQIHGYRIDPNEKPEMHTFEVYRKMQSLETIRVEELPRKVIDELAHILTLNTEREGIEEAINAKLKDIFSQDQVLELVQFRKNNSSLFSKGWHNFSLKLMMELIPELYETSEEQMTILTRLGKQKSKETSKRTKYIDEKELTEEIYNPVVAKSVRQAIKIINEATKRYGIFDNIVIEMARENNEEDAKKEYIKRQKANLDEKNAAMEKAAFQYNGKKELPDNVFHGHKELATKIRLWHQQGEKCLYTGKNIPISDLIQNRYKYEIDHILPLSLSFDDSLSNKVLVLATANQEKGQRTPFQALDSMDYAWSYREFKSYVKDSKLLSNKKKDYLLTEEDISKIEVKQKFIERNLVDTRYSSRVVLNALQDFYKEHQFDTTISVVRGQFTSQLRRKWGIEKSRETYHHHAVDALIIAASSQLRLWKKHNNPLISYKEEQFVDSETGEIISMSDDEYKELVFKAPYDHFVDTLKSKKFEDSILFSYQVDSKYNRKISDATIYATRKAKLDKDKSEETYVLGKIKDIYSQAGYDTFIKIYNKDKSRFLMYHKDPQTFEKVIEEILRTYPSKELNEKNKEVPCNPFEKYRQENGPIRKYSRKGNGPEIKSLKYYDNKLGNHIDITPNESMNQVVLQSLKPWRTDVFFNHQTEKYELMGLKYSDLNFEKGSGKYSISLEKYNSIKMNEGVSEESEFKFTLYKNDLILIKDALTKEAQIFRYGSRNDTSKHYVELKPYDMSKFEGDERLIKVLGTVAKGGRCIKGLNKKDISIFKVKTDVLGNKHFIKKEGEEPKLKF

SEQ ID NO: 590 - protein, 1337 aa, Listeria monocytogenes
MKNMKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 591 - protein, 1384 aa, Coriobacterium glomerans; identical to SEQ ID NO: 150

SEQ ID NO: 592 - protein, 1337 aa, Listeria ivanovii
MKGMRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIEEGSLTRLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGKTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 593 - protein, 1079 aa, Listeria ivanovii
MMSKLILGLDIGISSVGWGVLDESTNEVVDAGVRLFEEATRNGNEDRRGFRSARRLKRRRQHRLERAKGLIENNGFSCTDINKFNPYQARYNAIFGEVTKDELAAALFHLVKRRGTTIDAPEEEVKDVENELSTKMQLEKNAKKLATKYDYICEIQLEKLKENKVVRDHENRFRTEDYVKEARAILENQQEYYPEVTNEFIESYMALIETRRMYYDGPGSEKSPTPYGQYFIDKNGTPQHITMIDKMRGKCTYFPEEVRIAKMSYTAELFGLLNDFNNIYFADPETGEKIGFTEADKKYFIDTFIHDQKGVKNITLKQIMKHKNIINETDIFGYRINTKNGTPIFTEFKGLKALKKALKEVDLPDEFYQNTEMMDEIANILSSEKSFTRREEQLKELFLAAFNDELEEAVKELINDITFKEFHSLSKKAIMVILPELWSTNQNQMQLFVQHKMDKSRLENLQNGTKIQFDDEAILSTIAKRAHRETIKIVDAVRAKYGELDYVIVEMAREKNSDEQKKVYNRAQKKQGDFEKEMCKLLGVSELKELRLNGKQHLALKFWKEQDGKCIYSGKPIALSDIVNNFNGLLEIDHIIPISISYDDSQQNKVLCLRSENQRKGQLSPYQYLIRGMGERSFDAFKAEVLSRHFGKKKQNYLLEMEDIANNDELRKHFINRNLVDTRYAMRTFSNTLKTFYTVNGIPTKVMPVNGAMTSALRKRAKLNKDRDAGHAHHAIDALIVAAIGRLPLIKQLAELRVNEEGEFADKITDKGLDDKTAFDDKTLKFLRNLLNYESKVKYSHKVDRKPNRSLSKQTLYSTREKDGEKYIIGKVKNIYTLDKAGYAALKKRIDKNPEDFLMAQHNPKTWEEIIKIMEVYSKADNPFKEFYDEHGFIMKDGKVPVKSLRYHDKKLGIHVPLTHKYENTRHDVVLLKRNSLRVDIYMNKEGVYKYQGVPYNWFNQKGDKYILDMEKYHNEIDGTRASFKNIDNTFEFQFSLYKNDVFSYMKKDKEGEFVSYTKLFRSDSSPRENRLEVENIDMRTSSQQMPTINPLKNLIKYNTDILGNTYPIQKEKFVTVFTLHSK

SEQ ID NO: 594 - protein, 1095 aa, Actinomyces naeslundii
MSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 595 - protein, 1422 aa, Sutterella wadsworthensis
MTQSERRFSCSIGIDMGAKYTGVFYALFDREELPTNLNSKAMTLVMPETGPRYVQAQRTAVRHRLRGQKRYTLARKLAFLVVDDMIKKQEKRLTDEEWKRGREALSGLLKRRGYSRPNADGEDLTPLENVRADVFAAHPAFSTYFSEVRSLAEQWEEFTANISNVEKFLGDPNIPADKEFIEFAVAEGLIDKTEKKAYQSALSTLRANANVLTGLRQMGHKPRSEYFKAIEADLKKDSRLAKINEAFGGAERLARLLGNLSNLQLRAERWYFNAPDIMKDRGWEPDRFKKTLVRAFKFFHPAKDQNKQHLELIKQIENSEDIIETLCTLDPNRTIPPYEDQNNRRPPLDQTLLLSPEKLTRQYGEIWKTWSARLTSAEPTLAPAAEILERSTDRKSRVAVNGHEPLPTLAYQLSYALQRAFDRSKALDPYALRALAAGSKSNKLTSARTALENCIGGQNVKTFLDCARRYYREADDAKVGLWFDNADGLLERSDLHPPMKKKILPLLVANILQTDETTGQKFLDEIWRKQIKGRETVASRCARIETVRKSFGGGFNIAYNTAQYREVNKLPRNAQDKELLTIRDRVAETADFIAANLGLSDEQKRKFANPFSLAQFYTLIETEVSGFSATTLAVHLENAWRMTIKDAVINGETVRAAQCSRLPAETARPFDGLVRRLVDRQAWEIAKRVSTDIQSKVDFSNGIVDVSIFVEENKFEFSASVADLKKNKRVKDKMLSEAEKLETRWLIKNERIKKASRGTCPYTGDRLAEGGEIDHILPRSLIKDARGIVFNAEPNLIYASSRGNQLKKNQRYSLSDLKANYRNEIFKTSNIAAITAEIEDVVTKLQQTHRLKFFDLLNEHEQDCVRHALFLDDGSEARDAVLELLATQRRTRVNGTQIWMIKNLANKIREELQNWCKTTNNRLHFQAAATNVSDAKNLRLKLAQNQPDFEKPDIQPIASHSIDALCSFAVGSADAERDQNGFDYLDGKTVLGLYPQSCEVIHLQAKPQEEKSHFDSVAIFKEGIYAEQFLPIFTLNEKIWIGYETLNAKGERCGAIEVSGKQPKELLEMLAPFFNKPVGDLSAHATYRILKKPAYEFLAKAALQPLSAEEKRLAALLDALRYCTSRKSLMSLFMAANGKSLKKREDVLKPKLFQLKVELKGEKSFKLNGSLTLPVKQDWLRICDSPELADAFGKPCSADELTSKLARIWKRPVMRDLAHAPVRREFSLPAIDNPSGGFRIRRTNLFGNELYQVHAINAKKYRGFASAGSNVDWSKGILFNELQHENLTECGGRFITSADVTPMSEWRKVVAEDNLSIWIAPGTEGRRYVRVETTFIQASHWFEQSVENWAITSPLSLPASFKVDKPAEFQKAVGTELSELLGQPRSEIFIENVGNAKHIRFWYIVVSSNKKMNESYNNVSKS

SEQ ID NO: 596 - protein, 1186 aa, Porphyromonas catoniae
MGKKVLGLDLGVGSIGWCLITLDKDEKPQSILGMGSRIVPLSADDATEFTQGKAITKNKMRTVARTIRKGMDRYQLRREALKKVLREHGMLPDEALIKLPLLELWELRARAATPGEQLSLTELGRVLLHINQKRGYKHAKADEAAEAETESKAKKEKESYVAQVKGRYQALKEKGQTIGQHFAGELRANQQTAPRGTYYTYRIKKQVYPREAYIEEYDRIMAAQRVFYPELLTDALIGRIRDRIIFYQRPLKSCKQLVSFCEFEKKEKVIRVKHTNKEGVEELVEKTITIGPKVAPKSSPIFQVCKVWESIHNIRLYHPDGTERVLEQEEKQKLFDYLQENDKLSLTVLRKELKIKPKDKLWCDKLLVNGIAGNTTAAILRKVLKGYEQYEGLLRFNLTTRDSHEVDEDGVIRPIIDESYQNEPLYKLWHILYSIEDREEMRSALIGQLGIKAEDLDSGLMDALYKIDFVKQGYGNKSAKFICKLLPHLQEGKMYSEAAEAAGVRHSDSMTAQERDERSLLEEIPLLQKNALRQPVVEKILNQMINLVNALKREHGEIDEVRVELARELKMSREEREQVLSNNRKRKGKNETIAKRIAAEDITPTKARIQKYSLWEESGGRCIYCGNPVGVVQFLRGEEIEVEHIIPRSILFDDSMSNKVCACRSCNQEKGNRFAMVYIQTKGWEQDYISRIETLFKGKKISDSKRQRLLMLPENLPEDFIERHLRLTQYISREAQGILRKGIRLVSASEGGVTAKLRQLWGYDNILRDLNLERYRSMGETEVVTVEHRDGERTDERIKDWSKRKDHRHHAVDALIVACTRQSYIQRLNRVNAEADRQEMDAFIKEQQEQKPSKKEKLSLLEHWLIRQPHFTTGEVTKHVEGILVSLRPGKRTISRGRNIYKRSGKTDVQRGVLIPRGALSEETIYGVISVDGVDKVVCKYPLQSLKPKDVGYIVDEVLREKVRERISQYGEKQAFAEPLYLDEAKTQEVRSVRCFTGKDQSKLVPLRYNIEGEAVGFVAPGNNHHLALYKDDDGNVVESIVTFWQAVERARYGLPIVVVNPREVMEKALAIPELPESVLRALPASNLRLMEVLRMNDMFLIGMKDGEIQAAIEGEDYPTLSRHLYRVQKLATHDYVFRYHLETTLDGKDNVGEIPKSYRAQSLKAYVKLNPRKVKIDLLGRISLV

SEQ ID NO: 597 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 598 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 599 - protein, 1094 aa, Afipia sp. P52-10
MKYRVGFDLGTNSLGWAVVRLNASGEPDRIEVAGSRIFSDGREPKSGASLAGARRDARAMRRRRDRFKQRQAALIKYLTQAGFFPADESERKALSALDPYELRARALDEALPLAHLGRALFHLNQRRGFKSNRKTDRGKNDDTGKIRIGVARLYEQMRDADARTLGEFLHKRRAAASDPNAIPHVRTRIVTLAAEDGKASDVYDFYPDRQTLEEEFEAIWEAQTSHHPEALTEERRAQFYEIIFHQRPLKQPKIGFCTLLPPEKRLPKAHPLFQRRRLLEEVNALRIVLPGKETRALEKAERDALLSKLNQRKKAAYESLRKALKLDPDARFNKESDNREDMIGDEIAAEMAHKSRFGKVWLGMSAEAQAQVIERLRGLESDADADDFEAWLRDDHGLAQEQAKAVTAANLPEGYGRFGETATRKLIAALEQEVIVYSEAVQRAGLGHHSDLRDGQVWTDKKGNPALPYYGAVLERHIVPGTADPNETDDALRIGRLTNPTVHIGLNQLRRVVNALMRRYGQPQEIAIELARELKLSDDRKKEINTRNRENRKAAEKRSQKLRNIGQADKGGNRALLKLWEELNPENVLDRRCVYTGRVISIDMLFSGAAEVDHILPFSVSLDDSNGNRILCLREVNRIKRQRTPWEARDDLRAHFGPDAGWEAIAARAARLPREKRWRFEPDAANRFDAQGGFLARHLTDTQHLSRLARSYLSALYPETGEGSGHVWVSPGRLTEMLRRAWSLNHHLPDHNIAGAANQPKNRKDHRHHAIDAIVVALADRAMLNRIARESGKEGHEAAGRLVASIPEPWEGFSDEVGRAVRAITVSHRPDHGTASKAGRAKDKDATAGRLHNETAYGLTGEKDARGLDIVVTRKPLSAFKKSADLDAIRDDDLKQKLKAWAAGKEGGAFEQAMRSFGDPERGPRSHPGLRRIRVTEPLSVIPIRDRDGRPYKAYKGDSNYRFDIWELKTGKWKDEVVSMFEAHRPNWTSPIRAGNPTARKVLSVRQNDVIAIERENGPELMRVVKFSAGSLALAPPQEAGSLKARDADKNDPFKYVYGSPSSLQRWKARQVRIDELGRVFDPGFAVRSRRSSE

SEQ ID NO: 600 - protein, 1156 aa, Lactobacillus casei
MIIRTYELKTITTIAILKMFQLLTGGLSMTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKDIQLIFMGAISERTRPILPL

SEQ ID NO: 601 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 602 - protein, 1045 aa, Acidovorax avenae
MQKEKPLAYRLALDLGSTSLGWAVLRLSAPGEPSAVIRAGSRIFSDGRNPKDGSSLAVTRRAARAMRRRRDRLLKRKARMLAALERHGFFPQDEAARKALEKLNPYGLRARGLESALKPEEFGRALFHLNQRRGFQSNRKTDRKDSDSGALKQAIGTLRAQMHESGCRTVGEWFWKVRMERKPEGVKGQGVRARYRETPFTTDEGKKRIDKRYDLYVDRAMVAQEFDALWAAQATFAPALFNEAARAELRDILLHQRKLRPVQPGRCTLVPEEPRALLALPSTQRFRIYQEVNHLRVLHDELREEALTLAQRDQIVALLERQAKVTFTAMRKALGFSALFNLEDAKRDGLKGNATTAALGKKDLFGPLWAGFDTALQDEIVTQLMTEESEPRLIAWLQEHTGVDEARAQAIANAGLPEGYGSLGRTALARIVPELQRDVITYDKAVQAAGFAHHSDLGFSFEHDADEVERIGERTIASTGEIKPVFAFKQLPYYGRALQRHVAFAKENPRNDEERYGKIANPTVHIGLNQVRVVVNALMCRYGRPTEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRTPWDARTDFEAHGWSYDGILQRAERMPQRKRHRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRAHVERAVRHIWVSHKPDHGFEGAMMEETSYGILRDGTIKQRRKADGSAGREISRLIRITEPSQPQRHGVDAEGRPLPYKGYVGGSNYCLEITVNDKGKWEGQVISTFDAYRIVREGGLRQLRHSTQGQNGQALAMRLVIGDSVRLEVDEQERVMRIVKINGNNGQVFMAPVHEANVDARNSDKNEAFAYTSKIAGSFQKTKARQVTISPIGELRDPGFKG

SEQ ID NO: 603 - protein, 1046 aa, Gluconacetobacter diazotrophicus?
MIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 604 - protein, 1335 aa, Urinacoccus massiliensis
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENLEIIYNDELLTQIENIFKQDISRSKKLDQAIALFQGVKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKKLLEKDEDEILEEIIKILTIFEDRKMRKRQLMKFKDKLSEKAINQLSKKHYTGWGQLSEKLINGIRDEQSNKTILDYLIEDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSVHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKIEGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGASKENDSKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 605 - protein, 1391 aa, Tissierellia bacterium S5-A11
MKRNNDYYIGLDMGTNSVGWATTNPQGRLLRFNKKDMWGSRLFEEAKTAAKTRTFRTSRRRYDRVRQRIEFLQDIFAPIIAKKDFEFFMRLKESKFHLEDKKTDGKFALFNDADFTDVEYFDRYPTIYHLRAALIKPNHITDPRLLYLAIHHIIKNRGHFLFAGTDMESIRSFQIVYTQLSEHLKSINLDFELPVDAQDKFAAILLNEKLNKRDKKKQLKELCPHKDKRLEYAFNAIIGGKTKLKDIFGVEEYDEGTKKAVDFEKADYDEDKDEIESVIKENIHVLNALKAVYDWTILTNILGDYAYISESQVALYEAHKKDLRILKSLIKKYAKSQYADAFRHENVKGNYANYVGSTNYDNKQPVIDNPSVTQEDINKYFADILLSITPDESDRESYQYITERLHKGEALPKLRTKANSVLPHQIHKIELEKILANAAKNFPFLQEKDSSGYTAAQKIVKIMMFRIEYYVGPLNTYHHVDQGGHAWMVRKAEGKITPWNFDEKVDKEASAEKFIRNMTNKCTYLIGKDVIPKQSLLYSRYKVLNELNNLKVNGVPISVALKQKIYEELFKKQVNVTFNQLKTFLKTQGEDADEIILSGVDEAAHKFTNNLQTYHKFRAILRDKIEFEPQRSMVEDIIRWKCLMGDDITMWKHKIEKEYGDQLSEEQLKKITRLNFNGWSRLSQEFLTDVPGVDIESGEVYSGIMDALWRTNENIMQLLSSRFTFAAEVKKQNQGTGRIEKITYDEVMKDTYLSPAVKRSVWQAITLVEEIRKIRKADPKRIFVEMTRQPDAKKERKLSRRTQLLNAYRAIGNDIAEYEKEHVSTLITQLESKKDEDLRRKKLYLYFTQMGRCMYTGERIDLSSLLRDTNSNIYDIDHIYPRSLTKDDSLDNTVLCKKEINLKKGNKYIHRVFTDKELKKQYGYWKALKEKKLISERKFSRLMRTTDLTADELAGFISRQLVETSQMVKATADILEKIYPNVTIVYVKARTVSDFRHDYELPKVRALNDCHHAHDAYLNIVVGNVYYEKFTKSPFRFIANQKGKGDIKYNLYRLFDKDVKVGDRIIWNAKEDLARVKATLERDTVNVVRMPVEQRGQFFDATIQKKGTTKNMLVLPLKGSDERLQDTSKYGYYVRPSGMSFMVVQHEVKGKSRVTIEPALLVYKNKLKSEDDYAKYCEDVLKLQKPKVLFKNIKFGSKILFDGYPFLLKGRTENRIIMADAQSLFLGNQELKILKRVTKISDDIDHKVESRIKITDEEWTTLWKSVVEQIVTGKFRNRLGTLNGILQGRKIKLSKDEEARLNELDSKDQETFLSQILLERFLQFSTEEKTRLLLQVISFSGNTTGVDLRLIGGSSGTGTIKTNKNITDHSVILINESPTGLFTNRTVLNQP

SEQ ID NO: 606 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 607 - protein, 1068 aa, Verminephrobacter eiseniae
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRHIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 608 - protein, 1113 aa, Alcanivorax pacificus
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 609 - protein, 1380 aa, Prevotella intermedia
MKRILGLDLGTTSIGWALVNEAENNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKFQPLKWRVEALQQQVDKEVLAFVISDLKGQIANTSGLLGAISDRSKELYFNKQTVGQYLWASLEENPHISIKNKPFYRQDYLDEFEKIWETQAAFHKQLTPELKQEIRDIIIFYQRPLKSKKSLISVCELEQRKVKATIDGKEKEITIGPKVAPKSSPVFQEFRIWQNLNNVLLIDNDTNEKRPLDEVERNLLYKELSIKAKLSKTEALKILNKKGKQWDLNYRELEGNRTQAILFDCYNRIITLTGHEECDFKKIKASEIRHYVSTIFKNLGFSTEILDFDPSLKKHELEKQPMYQLWHLLYSYESDNSRTGNESLLRKLETTFGFPEEYATVLCDVVFEEDYGNLSVKAMREILPYLQAGNDYSQACAYAGYNHSRHSLTKEELDQKVYKERLELLPKNSLRNPVVEKILNQMINVINAIIDEYGKPDEIRIEMARELKSSAADRKKTTHAISQGNAENQRIREILEKEFSLSYISRNDIIKYKLYEELEPNYYKTLYSDTYITKDKLFSKDFDIEHIIPKARLFDDSFSNKTLEARNINLEKSNKTAFDFIKEKYGEDGAEAYKKKLDMLLENDAISRPKYNNLLRAEADIPSDFINRDLRNTQYIAKKACEILGELVKTVTPTTGKITNRLREDWQLVDVMKELNFEKYEKLGLTEIVEDRDGRKIKRIKDWTKRNDHRHHAMDALAIAFTKPSFIQYLNNLNARSNKGDSIYAIENKELHYEEGKLRFNAPIPVNEFRAEAKRHLSAILVSIKAKNKVMTQNVNKIKTKHGIIKKIQLTPRGPLHNETIYGTKMRPIIKMVKVGAALDEATINKVSSPAIREALLKRLNEYSGNAKKAFTGKNTLEKNPIYLNAGRTKTVPSLVKTVEWESFHPTRKLIDKDLNVDKVVDKGIREILKARLEEFNGDAKKAFSNLEENPIYLDEAKKIALKRVSIEGVLSAIPLHTLKNQAGKPITGKDGKPVLGNYVQTSNNHHIAFYYDEDGNLQDNAVSFFEAAERKSQGIPVIDKDYNRDKGWRFLFTMKQNEYFVFPNEATGFIPSEVDLTDEANYGIISPNLYRVQKVSRIDKGTSASRDYWFRHHLETILNDDAKLKNLAFKRIRGLLELKDIIKVRINSTGKIVAVGEYD

SEQ ID NO: 610 - protein, 1404 aa, Elizabethkingia meningoseptica
MEKTLGIDLGTNSIGWTIRNTDLSDNQIEDCGVITFEKGVASEKGNEFPKVQKRTESRGKRRNYQSEKYRKFALLDFLIQKNMCPLTIEEFDCWKNYRKGNKREYPQSEEFLQWIRFDFDGDGLPDFHLFGKDKNESYYIFRASVVDNNYKSVFDTNPHILGRILYQMVQRRGFKGRDEEEAKTMLTGSEKNGTKGRNDIAEYIEKYITVGAALYHYQKDFGGRIRQRYNLRKDYEHELKVICDVHNISQADYEKLWKAIIWQRPLRTQKGLIGNCIYEKNKKRVAVSHPLYEEYRTWVFINNLNILPPQGECLQEYLLDKIYPIFYKSKPDFELSDIDKQLKKDGAKRTSRHNEKTKVLSNKLLKQFQDIFGEDWKEELQWNITGDRSPQQNKREESLYTFEDIWHVLMTFDGQENLKKFAVEKLNLDEEKATKFSKIKLQQGFATLSLSAIKKILPYLQKGFLYNHSVYMANLYKMLDGAAISETLINHFSEEILKVLKSDSFNRKNAAIVNSLISEMLNDDNRYYISDNRDLDRSEYKTVLKNIIDTYGVEKWESFNEQQKTEITDFVSGKYLEFLKKTYSDKRNLFVQPERIHDKIFAFLQNTYHVSEDKKKYLWHPSEQENYAKADEYSEYSVGSKKYYVKAENVNHFLQRNPDAEAEGRQIKLLGNPEPLSKGFKNPMALKSLYKLKNLVNYLLQTGKIDEETRVVVEIARELNDKNKRKAIEIWQKDREKENESYRKELQTYREQFPHINLIDENTLIRKIRLWHEQNKICLYTGKPIPFSELITGNKYDIEHTIPASISFDNELKNLTISDSVYNRLHKGKRFPTQLSNYDSEQIINGETCNAIIRNIEFIFGERTVEYKEIKGKTEKIVKWRKIDELEKQFDEWKKKASYASTKEIKDNYIVKYHALKMDLDYLKEKLATFTITEYTAGWRNNQIRDTQIITKYALPYFKTLFKKVSVEKGSVTDIFKKVYKVQLRNDKKNRGVHSHHAQDAAILTLIPTAFHRERIIKAYQNEIDNRTGKTYHELPMDWDNFSEKYILDIKGNVLINNLTDNRTITQTYKTVRKRGKVVYDTDKEGSSHKRVSKGDTIRGQLHGETFYGAIKQPLRDEDNKILFDENKKMILKDEIYLAVRKPLVYKKDANSPGFKTLEEVEKVIVDKALFEMIKKQVEASDFKTALTDGIYMLDENGNKVNKIRRIRCFETGLKYTTAIKVHQHSFASGKEYKKSTLATNGENTYCLFYKNDMGKAMRILSIVDLAELKLKTIQSLYNEPEYGNFESGKGKNKYQIPLYTILKSGDKVLFYKENIYELKDLEQKELSDRMFKMYQFEKDGRIKFRHHLVAGIDTELKKDNQEYSSVNFEEKQVFLRLSQGQWNFAIEGKDFEMAFDGKINWKM

SEQ ID NO: 611 - protein, 1130 aa, Corynebacterium pseudodiphtheriticum
MNLSKRRLVSGGECSSRAFGPGFFIPERLWAMPVNYRVGIDVGTHSFGCAAIEVDDNDQPIQILSAVSLIHDSGIDPDQNKSATTRLATSGVARRTRRLYRRRRHRTIKLEKFLRSQGWKTKEFEHYSDPYLPWKTRVALVNGFIADETQRGEYLSIALRHIANHRGWRNPYWKVSSLYSPDAPSDAFEEIRKELEAKTKRKIPHDVTVGQLISFAQFGQDRLRGGGKKKDEKKSAGEFKQAVISARLHQVDHAREINEICRVQKINDTLRKQILDLVFAAESPKGAQSGRVGKDPLQPGKYRALKASDAFQRYRIAALIGNLRILHEGAIRRLYDNERHIIFEYLVNLAPKTEPSWLEIADLLNIDRGQLRGTATMTDDGERAGAKPPVHDTNRTILGCKVKPLAQWWKNASEPERAAMLKALSNAEVDDFDSPAGAQVQAFFAELDEKEHEKLDSLHLPMGRAAYSEDTLVRLTKRMNQENLDLYDARRAEFGIAEDWAPPAPRIGEPVGNPAVDRVLKGVARWLEAAADEWGAPKSVVIEHVRDGFISESKAREIDRENDKRHQHNEKLFREMEERLGIEGKPRSADLWRFQSVQRQNCQCAYCGSPITYTNSEMDHIVPRAGEGSTNTRDNLVAVCHRCNLSKSNIPFAVWAQKVSIPGVSVKEALERTKHWSVDSGLNKTEFNNFRGKVRDRFQRTAHDEPLDARSMESVAWMANELRGRVAQRFHQENTSVSVYRGAITAEARRAAGIANKLRFIGGPGKTRLDRRHHAVDAAVVAFTRQYVAETLAIRSNKKRAAELLRDVPRWKEFTGADEKRRAAWNVWLPKVQKLASLLQVALDEDRIVVTQNIRLRVGNGRAHKETIGKLKTIRVGDAISATDIDRASSEALWCALTRDKDFDAKAGLPENPERKIRIHGTWYGADDEIEVFPVGAGAIKVRGGYAELSRFHHARIYKVPKKTGYDYCMLRVYNTDLVRHRNEDLFSVELKPQTMSVRQAEQKLRKSLAENSAEYLGWIVPNDELVVDTSRIASAQLNEVQEIYGKIHRWRLLGFDSNSRILLRPLQLSAEGLPDDANAASKEIIKGRGWRTSINGFLTGGNVAVVRRDALGRVRLTSAAHLPVSWKVD

SEQ ID NO: 612 - protein, 1319 aa, Chryseobacterium indologenes
MFSQRNNPYCELLFKIIVTNIEEKNLEVIMGIRNSDIFFISNFMWYQKLIMMIKNILGLDLGTNSIGWALIEVDENNIPIRIIAMGSRIIPLSTSDKEEFQRGLSITKNQNRTVSRTQRKGYDRKQLRRSDLKKILKKYNIFPSEELLKLPMLDLWKLRSDSANPNEDISAEQLGRILYMLNQKRGYKSARSEANSDKKDTDYVQAVKGRYAQLKDRRQTIGQYFYEELSTAFSDKNNQQYFRVKEEVYPREAYIEEFDTIINAQKDKHGFLTDKVIHQLRNEIIYFQRKLKSQKGLVSICELEGFEKTVYDKEKNKNKVVFVGPKVAPKTSPLFQLCRIWEVVNTISLKIKNPEGSKYKWGEKVPNLKQKEILADYLFKNENLSFSTLLEILELKKEDVYVNKQILKGIKGNEAYAALHNVLGDHELLNFDVSIITSDHTAILVDKKTGEILEERAGLELDASLEREPLYQFWHTIYSLKDLDECKNALIKRFGLDEDIAEKLSHIDFNKQAFGSKSNKSMRKILPFLMEGYNYSESCSLAGYNHSNSLTKDERESQITLERLELLPKNNLRQPIVEKILNQMINVVNTILEKYGKPSEIRVELARELKQSKDERNDTDLQNSRNKKLNEEIGKRLAELGLPVTKRYIQKYKFIFPSLSKNLKDAHVNNQCIYCGETFNLTEALNGDAYDVDHIVPKALLFDDSQTNKVLVHRKCNSTKTNQTAYDYITAKGEEEVRIYSERVDDWFKKGIISYSKMQRLKVSHKEYLERKKLGKETETDKKLWENFIDRQLRDTQYISRKSREILQKVCNNVTTTEGGVTAKLRNLWGWDDILMNLQMPKYKELGQTITKEWTSEHGKRKHQKEEIENWTKRDDHRHHAIDALVVACTKQGFIQRINTLNSSETKDLMIKEVEEAKIEFNEKTTLLEKYLKTQKPFTTREVMKEADKILISFKAGKKVATITKFKATGKNKETGVIVPRGALHEQSVYGKIKVIEKDKPLKYLFENPDKIVNSRIRDLVETRLSENENNSKKALSTVKKNPIFFNEEKNEILEKASCYNDATVLKYKLQNLKANQVDDIVDERVKFLVKERLTQFGSKEKEAFKDILWFNQEKQIPIITVRLFARPDANNLQIIKKDKNGKDIGFVLTGNNHHIAIYEDKDSKLVQHSCAFWHAVERKKYNIPAVIKNSADVWSLLLDKELPVLFLDKLPADELNLKFSMQQNEMFILGLSQEGFDEAIKNNDKSLLSKHLYLVWSISNNDYYFRHHLETKNTELKNIPTAKDSKRYFRFKSVGALVGINPIKVRLNHLGEITKIGE

SEQ ID NO: 613 - protein, 1099 aa, Corynebacterium
MSLSYRVGIDVGTYSLGCTAIEVDDNDQPVNILSSVSLIHDSGLDPDQQKRAVTRLASSGVARRTRRLYRRRRRRMINLEKFLTSQGWETRPFEHYSDPYLPWNARVALVNGYISDDAQRGMYLSIAFRHIANHRGWRNPYWKVSSLYSPDKPSDAFEQIRKELEESTGHKIPETVTVGQLISFAQFGKDRLRGGGKKKDEKKPQEQVNQAVISARLHQIDHAREINEICRVQKIDDALRKQILDLVFAAESPKGAQIGRVGKDPLQPKLPRALKASDAFQQYRIVALAGNLRIYRDGVSTPLDRDEKLIVFNYLINLSHKEEPSWLKVAEVLNIDRGQLHGTATMTDDGERAGAAPPVHDTNRTILGCKIKPLVHWWEGANDDERAAMLKALSNSEVEDFDSPAGAQTQAFFANLDESEQEKLDSLHLPIGRAAYSEDTLMRLTSRMLDENLDLYEARLAEFDIPKDWAPPAPRIGEPVGNPAVDRVLKGVARWLEAAADEWGAPKSVVIEHVRDGFISKSKANEIDRANNARHKRNRELFKQMQENLGIDGKLRSSDLWRYQSVQRQNCQCAYCGSPITYTTCEMDHIVPRAGEGSTNTRDNLVATCHRCNLAKKNIPFAVWAAQTNIPGVSVKEALDRTRHWSEDSGMTSKDFKKFRKNVCDRLKRTVVDEPLDARSMESVAWMANELRGRVAQRFQEENTVVNVYRGELTAEARRAAGISDKLRFIDGTGKSRLDRRHHAVDAAVVAFTQNYVAETLAIRSNKKREAQLLQAAEQWKEFTGSDAEHRAAWNAWLPKMQKLAVLLQKALDEDRIAVTSNLRLRLGNGRAHEDSIGELKTIRVGDAISVTDIDRASSEALWCALTREPDFDENNGLPENPDRRIRIHGTWYDAEDDIEVFPVGAGAIKVRGGYAELSRFHHARIYKIPGKKAPVYCMLRVYNADLIRHRHEDLFSVEIKPQTMSVRQAEPKLRKALAENTAEYLGWLVTDDELVIDTSNFNTGQIAEMQSELGQVRRWRLDGFYSPSTLRLRPLQMSAEGLREDTSIGAKKIIDRPGWLPAINKLFGEGHVTVVRRDALGRARLTSNAHLPISWKAE

SEQ ID NO: 614 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLAFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 615 - protein, 1103 aa, Actinomyces sp. S6-Spd3
MTEINDDLRYRVGIDVGLKSIGFCAVEVDDKDQPLRLLNSMVFIHDAGVDPNENKAAKSRKLTAGVARRTQRRTAQNRRRLAELDRVLSEELHWPLPNLEDFEDPYEPWHTRAELVDHFIEDESERLEALSIAIRHMARHRGWRNPYIKVDSLLTPMEPSEFLRGLNERVGKALGREFPEDTTPGQLISAYMSDPKYRESNGIRGDDGILQGKLHQYDNAAEIRKICEVQRLDHDVFKLLVRRVFFAKSPRGSAAGLVGHDQLPGQGKYIRAEKAHPDFQLFRIVSVLTNLRVREAGAERCLTPEELSGLTDFLLDAGLKQQVTWADLADNLGIERADLRGTARPSVDGEPALRFPPTDVTTEKIMASKVKWLKEWWKSADSERRGFMVDALSNSGGSTGDNDIDDEVAELLEQATEDEQTELEKIQLPQGRAAYSLDSLRKLTERMLTEGVDLHTARKQLFNVDDDWRPEPEPIEAPVGNPAVDRVLKQVARWLNMATDRWGEPVVINIEHTRDGLGSEKVARELLRESQRRQDLNQKNMDEMIQQLGISGKARRSALVKHQAIQRQNSMCLYCGTTIGFETAEMDHIVPRANSGSSNERSNLAAVCRTCNHQKGAVPFAVWATSGQAHAGVSLEGAIERVRAWERDPAMRPKQYAHFREEVISRLKSRKPDEEFDGRSMESVAWMAIELRTRIDGFYRKLKAESVPNIGIYRGQLTAEARKASGFESRVNLIGGKGKTRFDRRHHAMDALVIAMMNQSVSQTLALRVNMRESQRITGQEETWKNFYGKPGQASDRFEQWREGMLRAVELFNIELAKNAIPFHENVRLRVGSSKVHDDTVRKFIHAKLGEALSVAMIDRAETPALWTALTRLPDFDPKEGLPEDPSREIYIHGRKITADEQLNFFNSPSACLKVRGGYVEIGSSIHHARIYRIDGKKTTYAMVRVFATDLVKMTHEDVFTTPLKPSTISMRTAEPKIRKALADGTVTQIGWLVEGDELQIETDKYLKGFVGEVLAQYPELTSWRVAGFPDPAKLRLRPYLLSVEGLEKGSSKELSDLLEGQGWRPAINVLLASGVVSVVRRNCLGEPRSNSQNSLPITQLLR

SEQ ID NO: 616 - protein, 1399 aa, Olsenella uli
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 617 - protein, 1391 aa, Lactobacillus melliventris
MKKRIDDYILGLDIGTNSCGWAVTDKKNNLLKLRGKTAIGSHLFEEGHTAADRRGFRTTRRRLKRRKWRLRLLEEIFAEPMAEVDPGFFVRLHQSWVSPLDKSRKKYQAIVFPTAKEDQEYYQKYPTIYHLRDALMTQDRQFDLREIFLAIHHIVKYRGNFLQDTAVKDFEASKIEVGPILTNINNAFADKIVEGQDLIELNVANAAEIEAVIRGKDADKTLYKMDKVKKIAKLLTDSTAKEQKNVAKQIANAIMGYKTQLETILGKEIDKNDKAQWEFKLSDADDKLDALLPDLDESDQTVVAEIEKLFSAITLSTIVDENKSLSQSMVEKYNKHHQDYKLLKAYIESLPDRAQAKKLLLAYDLYVNNRHGHLLEAKTEFKQDSTLTKEDFYKTVKDNLDDSELAHKIAQEIAADNFMPKQRTNSNGVIPFQLHQIELDKIIANQSKYYPFLAAENPVEDHRKQAPYKLDELVRFRVPYYVGPMITADEQEKTSGKSFAWMVRKEQGQITPWNFEQKVDRQESANKFIKRMTIKDTYLLGEDVLPANSLLYQRFEVLNELNNIRVNGSRISVDLKQQIFNDLFEEKKTVTEKALISYLKQNLHLPTVEIKGLADPTKFNSSLASYYHLKNLHVFDKELADPQYQKEFEKIIEYSSIFEDKKIFQDKLHAEFKWLTPAQFKAISTWRLQGWGRLSRKLLVELHDTNGQNIIEQLWDSQKNFMQIVTEPDFKEAIAKENQNITQENGVEEILADAYTSPANKKAIRQVVKVVADVVKAASGKAPAQFAIEFTRDPDKNPQLSHIRGTKLLKAYQETAGELVDQNLTNSLKEAMTSRKLLKDKYFLYFMQTGRDAYTGKKINIDEVSTNYQIDHILPQSFIKDDSFDNRVLTATPLNAEKSDDVPYKRFANNYVSDLKMTVGEMWKHWQKAGIINKHKLGNLLLDPDRLSKFQKSGFINRQLVETSQIVKLVSVILQNKYPDAEIITVKAGDNSALRQRLDLYKSRDVNDYHHAIDAYLSIVCGNFLYQVYPKYRPYFVYGQFKKFSQDPDLQKDLIKHFKGFTFMWPLLQKDNSERKALEEIKENNSDRIVFYKHPDIFDKLRKAYNYKYMLVSRETSTESSSMFNMTIYPRGERDRKKTRKLIPKGNGLDPKIYGGYSGNTDAYMVIVKIEKAKESIYKVIGIPMRALAGLKQAKNQGNYKEELHKVVEPQIMLDKNGKPKRGVEGFRVVKDHVPFKQVVLDGDKKFMLYSAKYETNAKQLTLSQETMRIVTDNLKKSEDQDKLLVKAYDEILQKVDQYLPLFDVNKFRNSLHLGRAKFLDLAVNDKKITLSNILNGLHDNLVVPNLKNIGIKTPFGLMQSPSGITLSSNAILIFQSPTGLFEKRVRIADL

SEQ ID NO: 618 - protein, 1057 aa, Skermanella aerolata
MSNRVPYRLALDLGTNSIGWCLLDLNGNGDPCGVRRMGVRIFPDGRDPKSKESLAADRRLARSMRRRRDRYLRRRSALMNALVAAGLMPADRATRKALESEDPCELRARALFEPLTAGQVGRALFHLNQRRGFKSNRKAAGEENEAGKIKAGISALKAEIEASGETTLGAWLAARHRKRETVRARLDGAGAKASYEFYPERGLVHDEFQAIRTAQALHHPAVTAEQWDRVESVIFRQRPLRPVRPGKCTLFPDQERAPWALPVAQEFRILTEIGNLKLYRPGEEPRELSADQHAQLFAKLCRSADLTFEKIRKELKLDPGLKVNLEGEKRDRLKGDAVTSALSAKKRFGPKWNALTPDDRRDIVGRLIEAEDEAELAGWLESVHGLPSENAAHTAASPGLPDGYCRLSEKALVKLVPLMREQRLRYDEAVLALNLHHSDFRPEGLLDELPYYGEPLERFIAFGSGEPSDPPEQHLGRFPNPTVHIGLNELRKLVNRIVERWGKPADIVVELARDLKRSRDERDTIQREQAQNQRKNEDRFAKIKELGIDPRPDSMLRLRLWEELPKVGVGHVCVYTGEPIGIRRLLEGDVDIDHILPFSRTLSDGADNKIVCVRRANRFKRDRSPWEAFGVTAVDGYDWAAIAQRAEELPKNKRWRFLPDAMDRFEGERGFLDRQLVETRHLSRVARQYLASIVDLNKVRVAPGKLTAMLRARWGLNKILSDGNLKNRSDHRHHAIDAAVLGMIDQRLVQLVAQAAARAEANELERLFDGLPDPFDGLAATSFGDQVREKIRGITVSHRAEHGWQGRMHNDTAYGPVEAVNGVHTVVTRKPLSGLTAKDFPNIRDRVLAKALEDHVAAEAAAGRSFGDALGSFKWGGQPVRRVRMLDVLGNPIPIQDPSGTVFKVYKGDSNAWYEILRDPRGRWTGKIVSTFEAYRLHREWLAETGGDSGRGSGVFLDWAAKRVVGEAGTPLFRLFKGDLLALGEAPDRRIVRVVKFSEGQVALALHLEAGNLKARDADKGDPFKYQYCSPDSLRKQAARPAGVDLLGYVHDKGPLE

SEQ ID NO: 619 - protein, 1021 aa, Ruminiclostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 620 - protein, 1274 aa, Pedobacter glucosidilyticus
MTKHILGLDLGTNSIGWAIIQVDNNNNVPIQIIAMGSRIIPLDSNDRDQFQKGQAISKNKDRTTARTQRKGYDRKQLKKSDDFKYSLKKILEKLDIFPTEELMKLPTLDLWKLRSDAVSNIEDITPKQLGRILYMLNQKRGYKSARSEANADKKDTDYVAEVKGRYTQLKDKGQTLGQYFYKELSDANQNNTYYRVKEKVYPREAYIEEFDAIINVQKSKHSFLTDEVIHSLRNEIIYYQRKLKSQKGLVSICEFEGFETTYFDKKTQQDKTIFTGPKVAPRTSPLFQFCKIWEVVNNISLKTKNPEGSKYKWSDRIPTIEEKQTIANYLQENENLSFIELLKILQLKKEQVYANKQILKGIQGNTTFSAIHKIIGNSEHLKFDIETIPSKHFAVLVDKKTGEILDERDSLELNSALEQEPFYQLWHTIYSIKDLDECKKALIKRFNFEEEIAEKLSKIDFNKQAFGNKSNKAMRKMLPYLMLGYNQSEAESFAGYNRRLTKEEKSKNVSDEPLQLLAKNSLRQPVVEKILNQMINVVNAIIEKYGKPEEIRVELARELKQSKDEREDADKQNGFNKKLNELVATKLTELGLPTTKHYIQKYKFIFPAKDKNWKEAQVANQCIYCGDTFNLTEALSGDNFDVDHIVPKALLFDDSQANKVLVHRSCNSTKTNNTAYDYITKKGSQALNDYVARVDDWFKRGIISYGKMQRLKVSFEEYQERKKIGKETEADKRIWENFIDRQLRETAYIAKKAKEILEKVCHNVTSTEGNVTAKLRQLWGWDNVLMNLQLPKYKELEKKTKQTFTQLKEWTSDHGNRKHQKEEIINWTKRDDHRHHAIDALVIACTQQGFIQRINTLSSSDVKDEMKKELEEDKTVYNERLTLLENYLLEKKPFSTEEIEKEADKILVSFKAGKKVATLSKYKATGINEIKGVLVPRGPLHEQSVYGKIKVIEKDKPLKYLFENSDKIVNPLIKHLVKTRLLENENNAQAALVTLKNKPILLNNKQTEILEKASCYNEATVLKYKLQSLKASQIDDIVDEKIKFLIKERLSKFGNKEKEAFKDILWFNEKKQIPITSIRLFARPDANNLQVIKKHEKGKNIGFVLSGNNHHIAIYEDKNNKLIQHICDFWHAVERKRNNIPVLIEDTSTIWNHLINEDFSESFLNKLPNDSLKLKFSLQQNEMFILGLPKEQSEEAIKSNNKSLLSKHLYLVWSITDGDYFFRHHLETKNTELKKIDGSKESKRYLRLSTKSLVDLNPIKVRLNHLGEITKIGE

SEQ ID NO: 621 - protein, 1485 aa, Prevotella bivia
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSLRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGIIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHTLSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEDFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDVICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKEHQPIYKVRVTEPLGAKYPIGTMGNKPKKFVEAQAGTNLYFAIYEDKEGNRNYDTIPLNIAAERLNQQLSPVPETNENNIPLKFYLSPNDLVYVPSEEERHSGNNIQLDKNRIYKMVSSTSKQCFFIHHRVAISLVDKKEFSAQNKMERSIDNEQVMIKSVCWKLITDRLGNIIKVIK

SEQ ID NO: 622 - protein, 1203 aa, Bifidobacterium longum
MPQGLTGHSGHTFWPTSSSPPIQLEQEKRPLPQRNTSQNGHTFWPITRERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 623 - protein, 1398 aa, Streptococcus equinus
MEKSYSIGLDIGTNSVGWSVITDDYKVPAKKMRVLGNTDKKYIKKNLLGALLFDSGETAEATRLKRTARRRYTRRKNRLRYLQEIFAKEMAKVDESFFQRLDESFLTDDDKTFDSHPIFGNKAEEDAYHQKFPTIYHLRKHLADSQEKADLRLIYLALAHMIKFRGHFLYDNFNDDNFDWRNIDIQKRYEEFIETYDSTLGESYLADISVDAASILEEKVSKTERLENLLKYYPTEKKTTFFGNLIKLILGQQAKFKAIFNLEDEISLQFATPTYDEDLEELLGKIDNGDSYSELFVAAQNLYNTILLASFLKTDNKSAKAPLSTSMIERYENHKKDLAKLKDFVKKNCPDQYHDIFRDKSKNGYAGYIDNGVSQNDFYTFIGKCLEESLKKDKGAQYFLDKIDRDDFLRKQRTFDNGAFPYQIHLQEMHAILRRQGDYYPFLKENQDKIEKILTFRIPYYVGPLARKDSRFAWANYRSDEAITPWNFDEVVDKEKSAEKFITRMTLNDLYLPEEKVLPKHSLIYETFTVYNELTNIKYVNDQGNAIHFDSELKEKIFNQLFKENRKVSKKTLIDFLNNSEGIYTDKLVGIDEEVKYLNASLGTYHDLKKILESFMDDEINEKIIEDIIQTLTLFEDIEMKRQRLQKYDDIFTPKQLKELARRNYTGWGRLSYKLINGIRNKENNKTILDYLKNGNRNFMQLINDDRLSFKQIIIDARKIEKLDNIESVVYNLPGSPAIKKGILQSIKIVDELVKVMGHNPDNIVIEMARENQTTNQGKNRSQQRLKRLQDSMSNFKDSSISLKDVDNSDLQNDRLFLYYIQNGKDMYTGEELDIDHLSDYDIDHIIPQSFIKDNSIDNRVLTSSAKNRGKSDDVPGRDVVLKMKPFWKKLYDVKLISKRKFDNLTKSEHGGLTESDKAGFIKRQLVETRQITKYVAQILDGRFNTKRDDNNKVIRDVKVITLKSSLVSQFRKDFGFYKVREINDYHHAHDAYLNAVVGTAILKKYPKLAPEFVYGEYKKCDVRKLIAKSGDKSEIGKATAKYFFYSNLMNFFKRVIRYSNGMIVVRPVIEYSKDTGEIAWDKEKDFKTVCKVLSCPQVNIVKKVEKQSHGLDRGKPKGFYNANPSPKPKKGSKVNLVPIKANLNPKNYGGYAGISNSYAVLVDATIEKGAKKKLTRIQEFQGISIIDREKYEKNKVEFLKGLGYKEIYSIITLPKYSLFELADGSRRMLASILSTNNKRGEIHKGNELVLPAKYIPLLYHANRIHNTFETGHREYVEKHIAEFKEIAEIILEFNNKYVNAKKNSSIIEKALESFDSFSLDEICDSFVGKLKKNNTKKNSGLFELVSLGSASDFEFLETKVPRYRDYTPSSLLNATLIHQSITGLYETRIDLSKLGEE

SEQ ID NO: 624 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 625 - protein, 1362 aa, Eubacterium ramulus
MGTDSLGWAVTDSSYHILRAKGKDLWGVRLFPSAETSVERRTYRVNRRRRQREVARIGALKELFADEIEKVDPGFFVRLDESKFHMEDRSENNKQKYGLFADKLFSDAGYYKKYPTIFHLRKELLESEEPHDVRLVYLALLNMFKHRGHFLNSSLQIEGENSNIAESYQMFVDTLTDEDLDFPEQVSGERLQEIFRSSDSRKKKVENLLAEMNLSKKQKREIQFVNLICGLKGKLSELFPDKEYDEEQKKIAFSFQDSDYEDKENTIQELLDESEMNMIYAVKAVHDSGVLSGIMNGERYLSVARVASYEKHKKDLQILKDILKKYDTKEYFEMFRNESAKSESYSAYVGSVKYHGTFRRGLSGGKQEDLYKHIKKVLGKFPQDDEGVTYILEEIETESFLPKQLTASNGVIPNQVHAREMLAILKHAELYLPFLQEKDDTGLSVSEKILKLFMFQIPYYVGPLGQEYKDKKGYNVWAERKASGKIYPWNFEDKIDVKKSAEKFIGRMVRRCTYLSGEQALPKQSLLYEKFQVLNELNNLRIRGEKIPVSLKQEIYHDLFGDGKKVSMTRLTNYLLQNGVISGEEKDSCISGIDGGFHNSLSSVGKFKGVFGDTVHTDEHRKMIEDIIFWGTVFGDGKKLLKEKVEEVYGNQLTEAQKKRIFGFKFSSWGRLSKAFLTMEGASKDDGEIKGLIQAMWDTNCNLMELLSDRFTYKDKLNEMVTTAEKPLCEWKIEDLDEMYLSAPVKRMVWQTIRVVDEVQQIIGCPPKRIFVEMTRSDGEKGKRTVSRQKKLVDLYKALGKEGKTWSEELSDTPESQFRIKKLYLYYLQMGKCMYTGEAIELEQLMNDNLYDIDHIYPRHFIKDDNISNNLVLVKKEKNAHKSDSFPIEPEIRNKMMPFWKSLRKKGFLTEEKYNRLTRMSAFTDEEKAAFIGRQLVETSQGTKAITQIFEQAFANSEIVFSKASVVSAFRQKFDCYKVRCVNNYHHAHDAYLNIVAGNTYRVKFTSNPLNFIKEAKKNPNSRENRYNMDKIFEWDVTRNGETAWVAQTKEHPGTIQLVKKYLNKNSPLITKMVYEKHGGITQKATIWSAKKAESGNTDAYIPVKMNDPRLADVTKYGGVTTIAVAGYTLLEYKAGGKTVRSLEALPIYLGGSKKLTEEQMVEYFSNVLQQENKEKVVSDVIIRKKMIPSGSLIKYNGFYYYLAGKTGDRIILISAVQLCLPMDTMLYIKKIEKACSTGNFEEKDKNGKQVLSKQQNEFVYELIIQKYQQSIFKKKVGAIGDTIIEKREKFAEISLEEQCKVLMQIFLNFQSGIGVELKIIEGGKKSGVTYLNKKVMNVQELKLIDQSVTGVFSREIDLLTI

SEQ ID NO: 626 - protein, 1509 aa, Bacteroides fluxus
MKTILGLDLGTNSVGWAVINSVIKEQAERIWIEMAGSRIIPMDAAVLGDFDKGNSISQTSERTRLRGVRRLRERQLLRRERLHKVLNILGFLPNHYLEYIDFEKHPGKFLSDAEPKLPWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQIKEFIVTTDLNPDSTPKLDKYGEVKRSFRAPKEDDWMLIKKRTEADIANTHKTVGAYIYDTLLQKPQQKIIGKLVKTVERKLYRDELSLILQKQCAFHAELQDRTLYARCVEALYPNNEVQRRNIANRDFVYLLMDDVLFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSRLEKANVCIDFLSNEKEVALWHILYSVSDKQEIEKALRTFAAKNGLDESFVEAFKKFPPFKSEYGAYSAKAIKKLLPLMRCGKYWDVSSIDDTTKERIKKIVAGEYDERIAVKVRDKVMNLSDISCFKRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDMVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKMLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKSRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDAPTMIVDKRVKNKVFELLSYKYDKKRIEKYFKENAVLWKELDLARVAVYYFTEATTEPLVAVRKPLDSTFNEKKIKESVTDTGIQKILLNHLCTKEGKPDLAFSAEGIEEMNRNLLQLNNGKRHQPIYKVRVYEPRGNKFSVGVLGNKGTKWVEAAKGTNLFFAIYITEDGKRTYETIPLNMVIEREKQGLAPVPDKNEKGDKLLFWLSPNDLVYLPTEEELEFGRINEPIDRGRIYKMVSSSGNQCFFIPQSISNAIIPTKELGANNKAERSWDGAMIKNICIPVKVDRLGRIIEVKYRINE

SEQ ID NO: 627 - protein, 1391 aa, Prevotella oralis
MKKILGLDLGTTSIGWALVNEKENNEELSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCNALKEDLKGKSRTQSSAIFYAKYKVSTAKIAGKDKRLQELTWRTDALRKQLTIDEVAYVICSINGEVNGSSQRLSMISDRSKLLYFNHQTIGQYLMQRLEENPNAGLKNIIFYRQDYEDEFNDIWNSQATYHKELTPELKKEVKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMANLYRAFQDIISLTGNGEFDFQAMPAEEAEKTVEEIFGGLGYKTAFLHFDASLHDKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKNYKTHLDEIKRNSLRNPIVEKILNQMVNVVNSVIDTYSNIDEIRIEMARELKKSKPEREDMSFAISKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGTKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNRGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNGSHTKHVPEKVKIVFFEDVFTIRKAITPDIKIDKVIDSKIRRILQERLNEFGGEASKAFSNLDENPIWFNRDKGIAIKSVKIRGIAKGTAIRVKKDIHGKTIIGNNGYPVANDYVNTGNNHHVAIFRDKDGNLQEHIVSFYEATARAIQNLPIVDRNYNSEKDWKFLFSMKQNEYFVFPNPNTGFNPSEISLKDEKNYALISPNLFRVQKLSHYYYVFRHHLETNVDTNLQLKDITWKRITAVNNLTGAVKVRIDHLGRIVDVGEYK

SEQ ID NO: 628 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 629 - protein, 1099 aa, Corynebacterium accolens
MSLLYRVGIDVGTYSLGCTAIEVDDNDQPVSILSSVSLIHDSGLDPDQQKRAVTRLASSGVARRTRRLYRRRRRRMVKLENFLTAQGWETLPFERYSDPYLPWHARVALVNGYISDDTQRGQYLSIAFRHIANHRGWRNPYWKVSSLYSPDKPSDAFEQIRKELEASTGRQIPETATVGQLISFAQFGKDRLRGGGKQKDKKKPQEQVNQAVISARLHQIDHAREINEICRVQKIDDTLRKQILDLVFAAESPKGAQKGRVGKDPLQPKLFRALKASDAFQQYRIAALTGNLRIYRNGVTVPLDRDEKLIVFNYLVNLPKKEEPSWLKIAEILNIDRGQLRGTATMTDDGERAGATPPVHDTNRTILDSKVKPLAHWWENASDDERAAMLKSLSNSEVEDFDSPAGAQVQAFFADLDETEQEKLDSLHLPMGRAAYSEDTLMRLTNRMLDENLDLYEARLAEFGIPKDWAPPAPRIGEPVGNPAVDRVLKGVARWLEAAADEWGAPKSVVIEHVRDGFVSKSKAIEIDRANNNRHKRNRELFQKMQENLGIEGKVRSSDLWRYQSVQRQNCQCAYCGSPITYTTCEMDHIVPRAGEGSTNTRDNLVATCHRCNLAKKNIPFAVWAEKSTIPGVSVKEALDRTRHWSEDSGMSKKDFQKFRKNVCERLNRTVVDEPLDARSMESVAWMANELRGRVAQRFQEENTTVNVYRGALTAEARRAAGITDKLRFIDGTGKSRLDRRHHAVDAAVVAFIHNYVAETLAIRSNKKREAQLLQGTSQWKEFTGSDDKHRAVWNAWIPKMQKLAVLLQIALDEDRIVVTSNLRLRLGNGRAHEDTISELKTIRVGDAISVTDIDRASSEALWCALTREPDFDEKDGLPENPNRRIRVHGTWYDAEDEIEVFPVGAGAIKVRGGYAKLSRFHHARVYKIPGKKAPIYCMLRVYNTDLVQHRHEDLFSVELKPQTMSVRQAEPKLRKALAENTAEYLGWLVTDDELIIDTSTFRTGLIEEMQSEFGLVRRWRLDGFDSPSLLTLRPLHMSAEGLPDDCALGSRKIIDTKGWRVSINKVFNAGNTTVVRRDALGRARLTSNAHLPISWKEE

SEQ ID NO: 630 - protein, 1392 aa, Streptococcus mitis
MNNNNYSIGLDIGTNSVGWAVITDDYKVPSKKMKVLGNTDKHFIKKNLIGALLFDEGTTAEDRRLKRTARRRYTRRKNRLRYLQEIFSPEISKVDSSFFHRLDDSFLVPEDKRGSKYPIFATLAEEKEYHKNFPTIYHLRKQLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQAEFKKHFDLEEKAPLQFSKDTYDDDLENLLGQIGDGFAELFVAAKKLYDAILLSGILTVTDPSTKAPLSASMIERYENHQKDLAALKQFIQNNLQEKYDEVFSDQSKDGYAGYINGKTTQEAFYKYIKNLLSKFEGSDYFLDKIEREDFLKKQRTFDNGSIPHQIHLQEMNAIIRRQGEHYPFLQENKEKIKKILTFRIPYYVGPLARGNGDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDITQYLHNVDGYDGIELKGIEKQFNASLSTYHDLLKIIKDKAFMDDAENEATLENIIHTLTIFEDREMIKQRLAQYDSLFDEKVIKALIRRHYTGWGKLSAKLINGICDKKTGKTILDYLIDDGYSNRNFMQLINDDGLSFKDIIQKAQVVGRTNDVKQIVHELPGSPAIKKGILQSIKIVDELVKIMGHTPESIVIEMARENQTTARGKKNSQQRYKRIEDALKNLAPGLDSNILKEYPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVTEKDKKNRNVKIITLKSNLVSNFRKEFKLYKVREINDYHHAHDAYLNAVVAKAILKKYPKLEPEFVYGDYQKYDLKRYISRSKDPKDVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDSKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVISEKYTTLLYHAKNINKTLEPEHLEYVEKHRNDFAKLLESVLDFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 631 - protein, 1036 aa, Helicobacter typhlonius
MRIFGFDIGITSIGWAYVESNELKDCGVRIFTKAENPKNGKSLALPRREARGARRRLARRKARLNAIKRLLCKEFGLNVSDYFANDGELPKAYETTKDTKSPYELRSLALEQKLEPKELARVILHIAKHRGYGNKHAKTGSDKDSGKVLSAIKVNETAMKDKYQSVGEYLYKEFYQKLRLESEKKGNNITKEFKNVRNKGENYEHCVAQEQVRAELELIFAKQKDFGATFSENFESQIIETAFYQRDLKSFEDKVGKCVFYENENRAPKDSLSAMEFVALTRIINTLKNLEEKSKNLGIGEVYGKDKIQEILKIVLDKGEMSYKKLREILHLDEHILFAKDSKLDYTQGVQEAEKAKFIELKNLKAFKKAMGGDFSNFAREELDKIATDITLVKSKENLAKKLQNYSALSKEQVEALSNLSFAKHIDLSLKALEQILPFMRGDKTGKCLRYDEAVKKAELQEHRKHKQKGEFLIPLKDYEPYLANPVVARALSEYRKVLNALLRKYGKVHKIHLEFTREAKLSAKERQKYEKEQKEHFEANQRAIQQCEILGLPINGTNILKMKLWLEQGECCAYSGEKITREHLLDSNALQVDHIYPYSRSFDDSYMNKVLVFAKENQDKGNKTPFEAFGGDKEKWDRILSLSAKLPKQKQRRISNTNFKDKEGGFLARNLNDTGYIAKLASQWTKDCLEFEDLRENEVTIAGEKGSSVHIEVVSGQLTSMLRHYWGLGNKDRNNHLHHAVDAVILAYTNNAMIKAFANFRKNQEENKKKFYAKQIAESEYKAKKAFFEPCKNFRQRVEEKIKEIFVSKPPRKRVRGALHQETFYPFEKLCNDKEYSEKLKMDYGGEKGMQKAIALGKIRQIGTKIVSNGAMVRVDIFKDKKGKFYAVPIYTMDFALGILPNKAVAIGKDKDGVIKDWIEMDSNYDFCFSLFKDDLILVQKKEMERAELCYFVSFGSTNAQINVEKHNNKFEGLSENEKILYSNATQKEVAGKSIGIQNLKTFEKYQVSPLGEVQKAEFEPHQEIKLKSSPKRKD

SEQ ID NO: 632 - protein, 1123 aa, Mobiluncus curtisii
MFVYLNSPRGFGPATFLTDLPHFCIIFGNNDFMDNRKYHVGIDVGTNSVGFAAVEVGDSGSPIRFLNTMVVIHDSGVDPEQKKYAITRLASAGTARRTRRLYRTRRQRLRELDDFISNELGYPLVNLENFADPYEPWKVRADLATIKLPADELPEAMSIALRHMARHRGWRSPYQRVEALHLHAEISEEFSALKKRVMEKTGDVFSDDATPAEVLVDLMGRQKIRGADGMLSGKLRQSDNANELRKIASVQGIDDETLNRIIDRVFFSRSPKGKASERVGMDALPGQGSKPRALKAMPSFQKFRIVSVICNLRIKDSGDDNRPLSMEEKEQLIGYLMSSTTDDHVTWTDVAELLHVKRSNLQGTAKEGPDGERPYTRPPVNSAWSKIKDSKIKSLVALWKTGDVDVQSAIVEALSNASVLEDARPGADIVVAYLESLDDKELESLDKVGLPAGRASYSEDSLERLTERMLQDDCDLFEARKREFGVSDDWKPPADPIYAPVGNPGVDRVLKIVNRLLMAAEREWGAPTQINIEHVRSGFSSELMQREFERENERRRAQNEEAVKAILTEKGGNSHVSKYDIIRYYAVKRQNCQCLYCGTPITFSDCELDHIVPRKGVGSTNSRVNLAAACRSCNRDKSNLPFAVWAGKTSNFDVSIDGAVSRVKQWQRSQNEGAREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETAREHFAVWKSNMERLTDLFNDKLENDAIPVVQPLRLRLSDSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKIFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILSGQGWRPAINVLFSKGKPRIVRRNSLGIERPSSNNGLPFSWEA

SEQ ID NO: 633 - protein, 1126 aa, Streptococcus
MNGLVLGLDIGIASVGVGILNKETGEIIHANSRIFPAATADSNVERRGFRQGRRLGRRKKHRSVRLNDLFEEFGFVTDFSDVPLNLNPYILRVKGLSEELTIEELFIALKNIIKRRGISYLDDASEDGETASSEYGKAVEENRKLLTDKTPGQIQLERFEKYGRVRGDFTVVENDENHRLINVFSTSSYKKEAERILKKQQEYNQDISDEFIQDYLTILTGKRKYYHGPGNEKSRTDYGRFRKDGTTLENIFGILIGKCTFYPDEYRAAKASYTAQEFNLLNDLNNLTVPTETKKLRPEQKRQIVEYARTAKTLGTPTLLKYIAKLVDGSIDDIKGYRIDKSDKPEMHTFDAYRKMRTLELVDVDILSRETLDDLAHILTLNTESEGILEALNSKMPGTFTKEQIDELIQFRKKNSAVFGKGWHNFSLKLMNELIPELYETSEEQMTILTRLGKQRSREISKRTKYIDEKELTDEIYNPVVAKSVRQAIKIINLATKKYGIFDNIVIEMARESNEDDEKKAIQNAQKANEDEKKAAMEKAANLYNGKKELPDSIFHGHKELATKIRLWHQQGERCLYTGKNISIHDLIHNPHHYEIDHILPLSLSFDDGLANKVLVLATANQEKGQRTPFQALDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQLVDPEMGEILSLTDDEYKELVFRPPYDYFVDTLKSKSFEDSILFSYQVDSKYNRKISDATIYGTRKAQLGKDKQEETYVLGKIKDIYSQKGYEDFIKRYKKDKTQFLMYHKDPQTFEKVIEEILKTYPDKELNEKGKEIPCNPFEKYRQENGPIRKYSKKGNGPEIKSLKYYDNKLGNHIDITPVNSQNQVVLQSLKPWRTDVYFNPQTSKYELMGLKYSDLRFEKGSGNYGISPEKYNKVKAKEGVDEDSEFKFTLYKNDLILIKDTETGEQQLFRYLSRNDGGSNKAQIKPYKKAEFEPKEKLMSILGNVPNSTSQCVKALNKTNISIYKVKTDVLGNKYFIKKEGDQPQLNFKKKI

SEQ ID NO: 634 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 635 - protein, 1102 aa, Azospirillum sp. B510
MQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 636 - protein, 1116 aa, [Clostridium] spiroforme
MVEFLLKEMKIMGRLVLGLDIGITSVGYGVIDIDKNEFVDYGVRLFKEGTAINNEERRSKRGARRLKRRKTNRIADMKKLLERNGLIDEQYTALNNPYEIRKKGLKNKLSNYELATAILHITKNRGTCLESNADETQDEESTKNILSKNALELKDKYICEIQLARLEESGKIRGINNNFKTEDYLKELSKILENQDLEKETIDKIKEIVARRRRYDQGPGSEKSPTPYGSYRMENGELVHVNLIDMMRGKCSVFPDQLRAPQQSYSAELFNLLNDLNNLKINGEKLSSTEKQKIIDFVNEKGGITVKQLLKLIDVGITEISGFRIDKNEKPLITEFKGYKKVLKVFKNYNQESLLNDKSIVDTIMDINTKIKSIDERSDQLKQVLPSLDTSIINDLASIKGVSGYHSLSLKALNLINNEMLKTEMNQMQVLHQLDIFDKNRVSLKGQRQIYADDNAILSPVAKRAHRETFKVINKLRSIYGEFDSIVIETTRDKNTQDQKKRIKNNQKNYEERNTEVNNFLKEAGYNPENINAKTKMKIRLYIEQDAKSAYTLQDINLKELIEDEKAYEIDHIIPISISLDDSFNNKVLTTHDENQEKGNLTPISAFLKGKFHNGNLNTYKVFIQNNKNLNRKKKEYLLCEDDITRYEVVQNFINRNLVDTSYACRTVMNTLVHYFKDNEINTKVHTIKGQATSTFRKRIGLIKDREEDYFHHAIDALIVASLKKMNLINSYLMKVDFNEMYDEETGEIFNVLPDNSYLDEKYISFVSNLKNIYEESNKYIRGVMIKEKMTYPLIKVSHKIDTKPNRKISDDTIYSTRNVDNQDMLVERIKNIYDPKENAANTLINDIINDNTDKYIMYHKDPQTFDKIKAIVLNHFNEFKTDKNCYIVTKEGLYKLKGTSPLALYYEEFGPITKYAKKNNGPTIHSMKFYSEKLGNHLSITHKYSTVNKKVITKQISPYRTDFYQSPEGKYKFVTVRYKDVAYNAKKDKYIIDHSWYREQKKLKKIADEWIFVCSVHRDELIGIMKADGQKRIFDSSTESDGETLYHDAKTYEILKFTATNNDITGRFEVKPIYCYCKKQLMVSIGTCRKIQKFATDVLGNLYIVKDNVLKLEFK

SEQ ID NO: 637 - protein, 1398 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLSNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 638 - protein, 1440 aa, Tamlana sedimentorum
MAKLGLDLGSSSLGWAIRDGDEISKKGVITFPSGMVKGQGGGYSSPTRDRREARSKRNLIRARKYRKWKLLEILCKNSEYVPLNILQLESWSKYKKGQARMFPENEKFLRWLSCDFSYQGGEMYKNPYELRVKALDQPLTKHEFGRVLYHLVQRRGYKDIGESDKETESQIKRRGESGFQKALDNNRTIAEALKNEFLDKGIRARNEYPYREEYQNELELICKAQGYNVSRDGKYDYQDQFVLSLWKSIVWQRPLRSQKGAIGKCTLEPSKLRCPVSHPIFEISRAWQFINTIKYYDKDDEKQNLPEDLKELLFNDVFIKKDNFKFEDIRRYLDKKFKQKTKYNYPLSKKTGKYETSVSGMPFCNGIIKILGDVAYDSLMNIEKYNIGNAPKIINGYSILDVWHAVFDFDEEYLEAFTNEKLKVENTTVKRNKKEVSLSPLVILKNKLTVGYGDLSVKALKKIIPFLKQGYLYNDAVMLAKLPKLMGNEWESQKEDILKLAKSSQETYNWCRIIVGITNNLIDAYKGEVEDWRETGKSVKAWKDFGYLLTEDDKREVINACIGYFGETSWDKRKDKETIISEVGKEYQEFFFDSKRVYREMPTLTSLFFETLSVNGIKLSGELYHHSTRKNIYGTKVTDKNTGKDILPIPLIDSIKNPMFNKSMSILRRLVNELILKGEIDKDTEVVVEVARELNDNNKRVAIERYQNERRKKREKIRAFLEEFKTKENKSFNVEERIRDFELWCEQSFEETFDKSGKKIVNKKNSEILSEKKAIRRYELWMEQKGQCMYTGKMIPIAQLFSNDIDVEHTIPRSLLPDNTMANLTVCYAKYNRENKGKLMPFFCENYEEDLAGIGTAIKPRLREWEKTMDNYKSLFESRLKSTGNEDEAKKNKRIQEKHYFRMHYEYWKDKVERFTTDEVKDSWARRQLVDTQMVSKYAREFLKTYFKKVAVQKGEVTAQFRKIYGFQETDKIKSRNKHTHHAIDAAVLTLIPVNSSRRDALLDKMYKMEEREGKQFSTKPFDLFNSQELINVIESQTLIVNYEKDKILQQTVKNVRKRGKLQYVKDKYGNFVTDEKGEKIIKKSQGDTVRSTLYKQTFIGKIRDVGRYPDGQPIRENGEWKYKTGEDEFLFTERKPLKDVLSKVDDIIDPVIREIIRTQKSQATDPQGNKIRHVRVKSKAGQVVKQRVNYRSKHEYKNYYYSAAGSIPYAVMLQKNINDKIERKIIPVASFEVSKVFMEHKKFSLELYLEMFHPNLSGYQDTKLLKVGQKVLMLNDDSEFEQRKDMEFQKNRLYRITQFANDGKRIMLKYHLEAQAITDVRKNVNEQKHKILTSEEVKMGISEILENTSITNLADRKKDFEKRKYNFNDRLNKIESVSNKLKKTQVKKMINNYQTEYSSFPENIIPSFLKISNNNWNFLYENYDFKVSILGKLIWLKND

SEQ ID NO: 639 - protein, 1360 aa, Lactobacillus casei
MTKLNQPYGIGLDIGSSSIGFAVVDANSHLLRLKGETAIGARLFREGESAAGRRASRTTRRRLSHNRWRLRFLQDFFDPHISSIDPDFFLRQKYSEISPKDKERFKYEKRLFNDRTDAQFYKQYPTMYHLRLHLMNDASKADPREIFFAIHHILKSRGHFLTPGDAKNFNTDDVDLKHIFPALTEAYAQAYPDLTLSFEPSKAEKFKSILLDEDATSNDTQKALVKLLLSDDGDKEVLKQQKKVLTEFAKAVAGLKVKFNVALGIEVTDADVEKWHFGMAQLEDKWSDIEPSLTDQGMEIFEQIQDLYRARLLNGIVPAGKTLSQAKVDDYDQHCKDLKLFKEYLKQLNDHDLAKRIRLLYDRYIDGDDAKPFLRDDFVKALKKEVTAHPTELAESLLERMEQDNFMLKQRTKANGSIPVQMQQRELDKIIANQAEYYSWLAAENPVKEHRDSKPYQLDELLNFRIPYYVGPMITKKQQEKSGQNVFAWMVRKDPSGNITPYNFDEKVDREASANAFIQRMKTTDTYLIGEDVLPKQSLLYQKYEVLNELNNVRVNGESLSTDQKKRLIRELFERHSSVTLKQFVENLVAHGDVAKRPDVRGLADEKRFLSSLSTYHQLRGILHDAIDDRGKQSDIENIITWSTVFEDASIFKSKLGEISWLDSKTRTTLSNIRYRGWGQFSRKLLDGLKLGNGHTIIQELMLSSRNLMQILTDETLKKEMATLNQERLKPDSINEAIDAAYTSPSNKKAIRQVLKVVDDIKHAANDQAPSWLYIETADGGGHPGKRTLSRQKQIQAIYENTAKELIDSAVRGELKDKIADKTNFSDRLVLYFMQGGHDIYTGTALNIDQLSSYDIDHILPQSLIKDDSLDNRVLVHAKINREKNAEFASTLFAAKMASTWHRWRDAGLISGRKLKNLLMRPDEVDKYAKGFVARQLVETRQIIKLTEQIVAAQYPDTKIIAVKAGLSHQLRQELDFPKNRDVNHYHHAFDAFLAARIGTYLLKRYPNLAPFFTYGEFTKTNLKKLQSFNFIGALTHTDGKITSKDTGEVLWDNQRDIEELDQIYNFKRMLITHEVYFETAGLFKQTVYAAKDSKERGGSRQLIPKKKGYSTGIYGGYTQETGSYNALVRLTKAGKVVYRVFKISTQNAAEIAAARSLSAEEGNERLCQILEQSLLKTNKDKKNTVDLFDVVIPRLGKEALFHNSKYGLFLVNSDTYYHNYQELWLSRENQKILKKLFSTKYDQSEMDRDALHLFETIAKQVEQFFKLYDINQFRTKISSAFDAFEKLPVEGEEGKVETLKQLLIGLHANPVRSDLKNLGIKTPFGFLQAGKGIHLDDDTEIIQQSPAGLFKRRVRLADL

SEQ ID NO: 640 - protein, 1369 aa, Lactobacillus iners
MNNNYYLGLDLGTNSVGWAVTDDHYNIIKFHGKHMWGMRLFEEAETAKDRRLHRQARRRRQRLVERINLLEELFDKEISKVDQGFFARKKESDLHFEDKTTKSEYALFNDKSYTDRDYYKQYPTIFHLIMDLIENDKKRDIRLVYLACHYLIKHRGHFIFDGKNFTVDNSFENLLDKLITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKILDNQSKYYDFLLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKVDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 641 - protein, 1021 aa, gamma proteobacterium HdN1
MPQLMRYRLALDIGSTSIGWAMIRLSMQNEPIAIIRMGVRIFSDGRNPKDGSSLAVTRRVARQMRRRRDRLLKRKTRLLNALVQKKFFPEDADARKALVVLNPYELRKEGLYRQLSGPEFGRALFHISQRRGFLSNRKTDKKDNDSSVLKKAIVDLRQQLEVENCQTIGEWLFKQQQSGKSVRARLRGKTQKDKAYDFYIDRAMIAHEFDTLWVSQAKYDPLLFNEDARAILRDILLYQRPLKPVKPGRCTLIPDESRAPLALPLTQQARIYQELNHLRITTPALGAQALTVAQRNTIAALLEKSDVTFVKIAKALGLTSTTEFNLQDIKRDRLKGNATAIILARNQYFGRRWHDFNADLQNLIVDKLVNEGSETALIEWLKANTDVDESAAERVSGVTLPEGYGSLSVAALRRLLPALKEDVVVYSEAVKRAGFDSHSALSLIEQTGELYQELPYYGEVLQRHVGFGSGDPNDSPERRFGKIANPTVHIGLNELRKIINALIKRYGNPAEVVVELARDLKLSREKRKEIQEEQKQRQDRNEKRIKDACEILGIDPLVIDRGKRREISQKMQLWDELNPKDAANRRCPYTGDQISIEKLLSAEVEIEHILPFSKTLDDSLNNKTVAMRRANRDKGNRTPYEAFGESLNPDYDYDAILQRASLMPREKRKRFASDGYQQWLRDDKDFLSRALNDTAYLSRIAKEYLTLICPPNSVRAIPGRMTAQLRAMFGLNRLLSEGGIKNREDHRHHAIDAAVIGVTDQGLLQKFSRASARTRELQLSRLVDDMPLPWDTYREHVTRALEHLVVSHKPDHGYQGKMHEDTAWGLRDNGQVTRRVRSEDGGPRQRLLENKNVVKINSTRDFSRHGIDEQGQVNAYKGYVGGSNYCIEIWIDEKGKWNSDVVSTFQAYQIVRELGEKAAWQKLRNPLLSLSAKPLVMRLIIDDVVKMQIAGQNKIMRVVKIAQNGQIFFAEHNEANVDARDKDKNNPFKYISKTAGSLQKAGGIHMAISPIGDARPVRYGR

SEQ ID NO: 642 - protein, 1142 aa, Actinomyces sp. ICM47
MIDSSENVPGIRYRVGIDVGLKSIGFCAVEVDRNDQPVRMLNSMVFIHDAGVDPNENKAAKSRKLTAGVARRTRRLYRTRHQRLVNLDRVLSKEFGWPLPDLTSFKDPREPWHVRAGLLEGYIADDEKRKEALSIALRHIARHRGWRNPYAKVETLLQPSEPSDFLKGLNDRISEELGRAFPADATPGQLVDTYLAHPDYVGRAGTPKLRGPQGILAGKLHQSDNAQEIRGICDVQRIEPAERDRLIRVVFEAKSPKGSAKERGLVGYDELPGQGRHVRAEKAHPAFQLFRMVSVLANLRIREGREERPLTPDELEDLVDFINQVSLKQEVTWQDLADKLRIERADLRGTAKASFDGSPVLRNPPTDVTTEKIMACKVKWLKEWWKEADDEQRGYMVDAFSNSGGSEDGTDVNDEVAELLEQATEDDQLEFEKISLPQGRAAYSLDSLRRLTDRMLRDGVDLHTARRLEFNVGDDWKPAVEPIGAPTGNPAVDRVLKQVSRWLHAATERWGEPTVINIEHARDGLGSERVARELMRENEKRRKANASAVAEMAAKLKLSGKVHRSDQIRYFALQRQNCQCLYCGAPITYTTAEMDHIVPRADGSSTNDRSNLAAVCRTCNHMKGKIPFAVWASSDKANQGVSLTGALERVNMWQRDSGMSPRQLKQLQREVCARLKSKKPDQEFDGRSMESVAWMAVELRTRIEGFYRSRDEESVPSVGVYRGQLTAEARRASGFESRVNLIGGRGKTRFDRRHHAMDALVIALMNPSVSRTLALRLNMRDAQRLTGVEETWKHFYGKPGEASKRFESWRESMLRGVELFNIALSDNAIPFVENIRLRVGSSVIHDATVHSFCPPKTPDGKQIITKGYGEQHSLGSAMPVELIDRAETPALWTALTRCPDFDPKKGLPENPQRTISVNGTRVGPTELVNFFEFSKSGPKACLKVRGGYVDLSGAIHHARIYRIAGKKTAYAMIRVFQVDLLRLKDHDVFTTPLKPSTISMRTAEPKIREALANGTATQIGWLVEGDELVIDTSKYSGGFIGEVLARYPEATSWRVAGFMTPAKLRIKPILLSKEGFVDETQAALLGVEVTSEAIQKTVDRPGWLPAVNVLFGAGGVRVIRRNCLGEERYHSSASLPVSMTLE

SEQ ID NO: 643 - protein, 1103 aa, Sphingomonas sanxanigenens?
MAWRLGLDLGTNSLGWAALSLDAAGAPDAILAAGSRIFGDGRDPQSGTSLAVDRRAARAARRRRDRFKQRQRALLKHLEADGLFPADPEVQQALAALDPYALRARALDEALSLHEIGRALFHLNQRRGFQSNRKADRGKDEDAGKIAIGVDRLKDAIAAAGARTFGEFLRQRRAGATGENQIPSVRTRLRAETGEGAKGSGYDFYPSRALLKDEFDAIWHAQAEHHPKVLTDEAYHRLHEIVFRQRPLRAPKVGACTLVPGEARLPKAHPLFQRRRLLEELNALMIVRAGAVAERLTPEQRDLLLLKLKDKGKVTFKSLREKVLKLDGDARFNKESEHRTELKGDEVAAEMGGKTRFGSLWPHLSTEQQWTVIERQQALESDADEAAFRTWLVETHKLTAEQARAVAGARLPAGHGRFGLTATAALLAALRDGRTPEGRGPNAPATEAGRVVVYSEAAAIAGYHHSDHRSGEVFTDAKGRPALPYYGVPLDRHIVPGTADPDEPDEAARIGRLTNPTVHIALNQLRRVVNRLIRVYGPPAEVALELARELKLSEDEKKERNRENSRNRLDAEKRSSKLAELGQRDNGGNRALLKLWEELNPENILDRRCIYSGRQISIGMIFSGAAEVDHILPFDATLDDSNANKILCLREANRDKRKRSPFEAWGGTPQWEEIAERASRLPRNKRWRFEPDAMERFAEEGGFLARHLVDTQYLGRIAHDYLRCLYPDKGDGSSHVWVSPGRLTEMVRRKLGLNGLLGDHNLGAEQPKNRKDHRHHAIDAVVTAILDRSMLQRIQRASGEGASDAELLRIIVPEPWTGFRDDLQRAVDRIVVAHRADHGTVAKAATRGRDQTAARLHNDTAYGFTGEADAKGTPIVVHRAPLGALKKPEHIDQVRDPLLRAALHDFTAGLSGKPFEDRIAAFPRLGPLDYRGIRRVRVVEPLQVIPIRDAAGRAYKGYKGDSNYRYDVWELPDGKWEQRVLQMYYAHQSGEPPRPHPAARKVLSLHRDDVLAIERGEGGRELVRVVKFSTNEFTLAPLNEGGALKSRHADKGDPFRYLYPSPSTLKAWRAREVRVDELGRVLDPGFPARKRRRVTRPGRADAD

SEQ ID NO: 644 - protein, 1361 aa, Lactobacillus rhamnosus; identical to SEQ ID NO: 153

SEQ ID NO: 645 - protein, 1263 aa, Mycoplasma dispar
MGKKHITIGFDLGIASVGWAIIESDTSKILNWGSRLFEERKTAQKRRGHRSTRRNIRRKAYRNQKFMNLILKYKELFGLENTSQISRIDKKDVENYKKIEEKFTEIYRNCANKYPNILDLKIKALNSKIEKLELVWILHDYLENRGFFYDIEQNSEEEKKKNKKFASKYKGSEFPSILLDRFFKKNGFFNSYGLVSEYGYNFSNLHWRNEISKLFEIQEIDYEFGKKFLDIFSSVRDYAKGPGSKNSISKYGVFEIDETGKVVEYENIWDKTIGKCSFFVQESRVSSNYPSYEIFNLLNQLINLSSELKLENGKNWQLKTKDRDFLLDKLLEARKNKKNKDASIEDDIIKIILADFGLEKTDITNDDSIQGRDIIKAKPTTKLETTNKLLKIIYSHSSNAKQVKSNNLVEFLPFLDKICAIVDHDKAREKNEVLKKLEEKGIFSKFQIIPEKQEKFLDSLFKEKLNFKKIGNLSLKAIHFFLPKMISQNKNSEFLKWNDLETRQTWEEEKNKIKKVNKKSKYLNPRIFEDEIISPGTKNTFEQAILVLNQIIKKYSKDYQIDAIIIESPRTKNDKKTTYKINKAIKESKEKDKKLFEALNLKEEGYTFEQLKSKSKSLFDKLRLYYQQEKLDLYDLDSSDEGEIKINDLIEKSQNYEIDHIIPYSMSYDNSQANKILTLRAKNGEKRKEIASKYARKKGEEYFKKYLEKVKELFIDSIKSKNNTDYVDLDKDSSKKKYRLLTLEDFDQYHAEFIARNLNDTRYSTKLFYHALRDHFQNNEHFEYLDEKSQIHKVKVATIKGHVTRYFRGKTGYSKDEIFENNAKEDESTHKKVIKKRRENNEHHAVDAAIVAIIGNENRQLANLLTISDNSFENYDEDHKLNVRTGEIVRKPKFEIEKFAKIDELKNKILEQCTIAKNEIPIKFSRKLRTILNCQISNENLCGFKFDENQNKYFKINKINLLNSTNEELEKYFINPFGTEESKYKVLMAESHKVEFERLKEIFFKYKEKGDAFAKYIDDLKKKEPELIDEIDAAKAIGKILYYKLEPLNQQTFYGEPKIVKKYYKNIRIIKYDSIPIQFKMLSKHDGGKSYKDDLRSLYSLVYKVYEKGKETYKSIPVNSALTKFGSNNNDLLDENNYNSQNLLLYKNDFTKPIPTGCKPIIAIKKGVILKKKNYEIQDDFTETEENGRYFFISGISKECGKNIDTRFTLRFIEISKDTVASKRVTDKIFKHYDLIHLDELGNEYPIKIKEHTEEEKKLCTIK

SEQ ID NO: 646 - protein, 1044 aa, Nitrosomonas sp. AL212
MLHKMRYRLALDLGSTSLGWAMVRLNANQQPCAVIKAGVRIFSNGRNPKDGSSLAVTRREARSMRRRRDRLLKRKARMMRTLIEYGFFPANETQRKALENLNPYALRAKGLDEALTPSEFARALFHINQRRGFKSNRKTDKKDSDSGALKTAIKQLHSVLDPQGNDGKPRTVGELLYKRFTDLSKLPKDRTVRARYRQDKIVKDDGKTKIDKYYDLYIDRAMIEQEFDALWKKQSELNPILFTENARADLKDVLLYQRSLKPVKPGRCTFMSEEERAPLALPSTQRFRMYQEVNNLRILREGLKEESLTLQQRDDLINALEKNNRRTFTQIKKLLGVGGSVQFNFEDPKREELKGNTTSAILGKSEHFGEAWFAFNEAKQDAIVLQLIKEENEAKLVRWLQDETGIDEKRAEVIANAGLPEGYGSLCIEALARILPELRRDVVTYDKAVQAAGFEHHSKLNRNEEIPDITFKIESIDRNSGEIKQFHLHKELPYYGEYLQRHVGFGSGKPEDSIEKRYGKIANPTVHIGLNQVRVVVNALIKRYGHPSEIIVEVARDLKQSKDRRDEENKRQAENQKRNERLRKDIADILGISEERVRRDDIEKMILWEELSFDPADRRCPYSGVQVSTVMLLSDEVEVEHILPFSQTLDDSLNNKTVALRQANRIKGNRTPWEAFGTSNISGFDYSGILTRAELMPKAKRYRFAEDGYQRWLKDDAGFLARALNDTRHLSKIAREYMSLICPNTRVIPGQMTAMLRRNFGLNDVLGLNGEKNRNDHRHHAVDACVIAVTDQGLLQRFAAASASARERQLNRLVENMPLPWESYREHVRRAIDGIWVSHRPDHSHEGAMHNDTAYGLRGNGRVSFHKMVEGKREYIEDNLKVIEITDTKAIDRHGLLPTGKPRPYKGYKGDSNYCIEIVRNEKGRWEGEIISTFDAYQLVRKYGIVQLRYPVLSVSGKPLVMRLIRNDFVRLEHEGITRTLRVCKMREDGQVALADVTEANVDARTRTKEICYVFKTGGSLQKAKARRITISPIGELRDPGFKE

SEQ ID NO: 647 - protein, 1346 aa, Pediococcus pentosaceus
MEKVPYNIGLDIGTSSIGFAATDNLNKPIRAKGKTVIGVRLFEEGKTAADRRGFRTTRRRLSRRKWRLRLLDEIFDKEMAKVDNTFFARLKESNLSPKDANKKYLGSLLFPEKKDFKFYEDYPTIYHLRYALMHEKRQFDIREVYLAMHHIIKYRGNFLNSAPMNSFKTQDFDFVAKFEKLNELFESIDAEHETKFDIENISKFRDIMLNQDIRKLDRKKQAAKILILDSTDKTAKKINNKIATAVANSALGYKFALDAILKLDVEESKDWSISLNDEEIDSILDNLTSDLDAERIEIIEILRDLYSHIALNEIVPNGQSLSKSMMDKYDKHHADLDVLKKVISNMDDRKKAKSLKNIYNQYVGKTNDKVLDKDEFYKQIQKNLDESEDAMKIVNEIELDQFMPKQRTSQNGVIPHQLHQKELDEIIENQKQYYPFLAEPNPNEKRKPHAQFKLDELIAFKIPYYVGPLITKEEQQAQSGAKFAWMKRKQDGVITPWNFDEKVDRMASANEFIRRMTTKDTYLLGEDVLPDESLIYQKFKVLNELNNVKVNDKKLTVSDKQDIFNDLFKKQKTVSVSKLQKYFVTEKHYLTEPTIKGLSDTKKFSNSLSTYIDFEKIFGNEILADQNKQNDLEKIIEWSTIFEDRKIFEDKLHEIEWLTEKQIKAVRRYRGWGRLSKKLLVDLRNNEGKSILDELWRTNDNFMQIQAREEFAKSIVEANQKLMNLGGAASVQNTVESTLEDAYTSPQNKKAIRQVIKVVEDIVKAVGYAPEKITIEFTRGADKNPRRTQNRQKQIMEVYKTAAKEIVDATLKGQLENEEKLTDKLYLYFTQLGKDIYSGETINIDQLNNYDIDHILPQAFIKDDSLDNRVLTSRDLNNGKSDSVPVKQFGANMKSFWMRLQAHGLISKRKLNNLMTDPDSIGKYTMQGFVRRQLVETSQVIKLTANILGAIYGENTDIVEIPAKLTHQMREKFNLYKVREVNDYHHAFDAYLTTFVGNYLFKRYPKLRPYFVYGDFKMTDNALKGMRRFNFLHDLKDDEVLVDNETGEVLWEGQKSIEELKKIYGYKFMLTTHEAYTQHGPMFKQTVYSSDTPGKLIKIKNNKPTEIYGGYTSNTDAYMAIVRIKARKGDTYKVVGVPRKEGDALSRIKLLDESKYHENLKNILAINLNKSLNKFDVVLDKVKYRQVIYDGTDHLMLGSSKYKYSTKQLVLSDQSMKILSSTGEFSDEELIKVFDEIMYIVNKNFSLYDTRGFRDKLNNARENFIKLPNKTLFEKGKLKQHSKLEILKQILIGLHANAGRGDLKDIGVNNFGAMVVTAGVTLSPDATIVYQSPTGLFERKVKLSDL

SEQ ID NO: 648 - protein, 1045 aa, Bibersteinia trehalosi
MKPRNLNYILGLDLGIASVGWSVVEIDENEYPIRLIDVGVRTFERAEVPKTGESLALARRLARSTRRLIRRRAFRLLKAKRLLKHHQIVNAEELTQLPNQCWELRVKGLDSLLSNTEWAAVLLHLLKHRGYLSQRKNEAQNADKELGKLREGMDNNSKLLLENNYRTPADIAVKKFAVEEGHMRNQRGAYTHTFNRLDILAEMQLLFKTQRELGSTYANGELEQAFCELLLWQKQALNRSQMLSLVGKCTFEKEEKRAAKASYSAERFVAIQKLQNLRILENGEERGLFDSEFSLLLENAYNLKSGLTYKQVRKILSLSENAIFKGLPYLSDDLEKPEKTQFLAFKFYHQLADILKNNGFSDEWQKLSQEPTLLDKLGTELSLCKEENEFIAQFNGELPEAMLSTLFNHTNFDKFIHISLKALNNILPLMEQGNDYTKAWRKVYPEPTKKDEKTLPPIPADEIRNPVVLRSLSQARKVINAVIRLYGSPARIHIETARELGKSYDDRQKIKKQQDKNSDERDQAVKKFLEECPNFANKVKGKDILKIRLYINQDGKCLYSGKPLDPHRLLEIGYVEIDHALPFSRTWDDSQNNKVLVLANENQNKGNQTPFEWLGKDEHQWALFVARVNGCRFPYAKKQRILTKKLDEQGFLKRNLNDTRYVSAYLMKHIKENLHLVGKGSDKVFASNGQVTNFLRRCWGLEKKREEGDRHHALDAIVVACSTASMRQKITLFKKYQRWNLKTGKHIDQETGEIIPLHFPAPWDFFRQEVMIRIFSEMPQEDLIMQLPDRPQANHEFVQPLFVSRAPSRKMSGQGHEAKLRSARMLEATGKSIKKEFLTDLTIKNLEHMVNKEREPELYQALVEHFKKYGDKPKEKFFKKGGVEVKSIRISKTQNKSVNLGNKTIADNGDIVRTDLFLKNKKYYFVNIYAWQVSKGILPKETTTGNILDNSYEFQFSLFKNDLLEIPHPKNENDSILAYFIRPDDERRWILKFHDNAKIPDIYGKKDETSIRLSIQGQKFIKKYQVDELGKNIRPCRPTKRQGVR

SEQ ID NO: 649 - protein, 1368 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKLYPQTSLFNDRTDRAFYDDYPTIYHLRYKLMTEKRQFDIREIYLAMHHIVKYRGHFLNEAPVSSFKSSEINLVAHFDRLNTIFADLFSESGFQLETDKLAEVKALLLDNHQSASNRQRQALLLIYTPSTNKAVEKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISNELLNNTEIRNELKDLSNSALSNTRLFLYFMQGGRDMYTGDSLNIDRLSTYDIDHILPQSFIKDNSLDNRVLVSQRMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWNKESGLAYLNKIYQFKKILVTREVHENSGALFNQTLYAAKDDKASGQGGKQLIPAKQDRPTALYGGYSGKTVAYMCIVRIKNKKGDLYKVCGVETSWLAQLKQLTDEDSKKAFLKQKISPQFTKVKKQKGTIVKVVEDFEVIAPHILINQRFFDNGQELTLGSATYKHNEQELILDKTAVKLLNGALPLTQSEELAEQVYDEILDQVMHYFPLYDTNQFRAKLSAGKAAFMKLPWKSQWDGNKMVQVGQQVILDRVLIGLHANAAVSDLGVLKISTPLGKMQQPSGISLSPDTQIIYQSPTGLFERRVALRDL

SEQ ID NO: 650 - protein, 1400 aa, Lactobacillus sp. wkB8
MKTITEDYILGLDIGTNSCGWAVMDKKNRLLRLRGKRAIGSHLFEEGHSAADRRSFRTTRRRLKRRKWRLRLLEEIFAEPMAKVDPAFFVRLHQSWVSPLDKDRKKYHAIVFPTAKEDHEFYHDYPTIYHLRDALMREDRQFDLREIFLAIHHIVKYRGNFLQDTPVNSFVASKIDVASFLTNVNQAYADKYGEEQNFIELNENNAAAIEAVIRGKDKDKTTKQLDKAKKITKLLQSSTNKYEKNVTRQIANAIIGYKTQFETILGKDIDKNDKADWEFKLSDGDADDKLENLLPEFDDNDQYIVAEIKKLFGSIALSQIVYENMTLSQSMKCKYKDHGDDYHLLKQYIATLSDHGQVRKLLLAYDLYVNNRHGRLLEAKKEFKQDKALTQDEFYKIVRENLDNSQLAQKILQKIEEEKFMPKQRVNKNGFIPYQLHQIELDQIIANQSKYYPFLAEENPVKEHRKQAPYKLDELVRFRVPYYVGPLISPDDKRKDKQQNKNHEMFKFAWMKRKDNNGAITPWNFAQKVDRETSANRFIKRMTVKDTYLIGEDVLPARSLLYQKFEVLNELNNIRVNGKRLEPKFKQKVFNELFKQKNKVTKKAFKEFILQNTGMKTAEIDGLADPTKFNSSLSSYYHLKSTKVFDKQLDDPEYQADFEKIIEYSSIFEDAEIYQEKLHKEIKWLIPAQFKAIANWRLQGWGRLSRKLLVELKGKGGENIIYQLWTTQKNFMQIVNEPELKKAIVKENHQATEEKGIEKILDDSFTSPANKKAIRQVIKVVDDVVKAAGGKKPAQFAIEFTREPKWNPQLSHIRGTKLLQVYEDTAKKLVDQSLTDSLKENMTNRNLLKDEYFLYFIQCGRDAYTGKKIDIADIHKKYQIDHILPQSFITDDSLDNRVLTEIEINQKKHKKYASHLFATKPAFGLNQSISEMWKTWQKAGLISQRKLNNLLFDPDLVKDKQKKGFINRQLVETSQIIKLVSIILQDKFPDTEIITVKAGYNTALRKELKLYKSREANDYHHAIDAYLTAINDNFLYQVYPNFRPFFVYGQFKKFSQDTDKQKEAIKYYGLKNFLEPLLDDSTGDEVMVNHTKHVVFHKQRDIFNRLIQAYNYKYMLVSRETTTENSNMFNMTIYPRGERDRKKTRKLIPKGKDLDPAIYGGYSGNTDAYMVIVKIEKTKETLYKVVGVPMRALASLKKAQKEGNYDQELNKVLEPLIMFNKNGKSKAGIKGFTVVKDHVHFKQVVIDGDSKFMLYSAQYRANAKQLTLSQETMKVVTDNTDDMDQKNADKDQLLLNAYDEILEKVDQYLPLFDINGFRQGLHDGRAKFAALKTSEKKYTLKNILNGLHDNLVTPNLKNIGIKTPFGLMQSSSGITLSPNAKLVFQSPTGLFEKRVKLTNL

SEQ ID NO: 651 - protein, 1380 aa, Eggerthella sp. YY7918; identical to SEQ ID NO: 151

SEQ ID NO: 652 - protein, 1323 aa, Solobacterium moorei
MKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 653 - protein, 1062 aa, Ralstonia solanacearum
MAEMQYRWGLDIGTNSIGWAVIALIDGRPAGLVVTGSRIFSDGRNPKDGSSLAVERRGPRQMRRRRDRYLRRRDRFMQALIDAGLMPGDAAARKALVTENPYVLRQRGLDQALTLPEFGRALFHLNQRRGFQSNRKTDRASAKESGKVKSAIAAFRASMGSARTVGEALARRLEDGSPVRARMVGQGKDEHYELYIAREWIAQEFDALWASQQRFHAEVLTDAVRDRLRAILLFQRKLLPVPVGKCFLEPNQPRVAAALPSAQRFRLMQELNHLRVMTLADKQERPLSFQERNDLLAQLAARPKCGFDMLRKIVFGANKEAYRFTIESERRKELKGCDTAAKLAKASALGARWQALSLDEQDRLVCLLLDGENDAVLAAALREHYGLTDAQIDTLLGLSFEDGHMRLGRPALRRVLDALERGRDEQGLPLSYDKAVVAAGYPAHTADLENGERDALPYYGEVLWRYTQDAPTAKNDAERKFGKIANPTVHIGLNQLRKLVNALIQRYGKPAQIVVELARNLKAGLEEKERIKKQQTADLERNERIRQKLQDAGVPDNRENRLRMRLFEELGQGNGLGTSCIYSGRQISLQRLFSNDVQVDHILPFSKTLDDSFANKVLAQHDANRYKGNRGPFEAFGANRDGYVWDEIRTRAAVLPRNKRNRFAETAMQDWLHNEADFLARQLTDTAYLSRVARQYLTAICPKDDVYASPGRLTAMLRAKWGLNRVLDGVAEAQGRLAVKNRDDHRHHAIDAVVIGATDRAMLQQVATLAARAREQDAERLIGDMPTPWPNFLADVRAAVARCVVSHKPDHGPEGGLHKDTAYGIVEGPREDGLYRVQHRVSLFDITPENLSKVDCDAPLRAELDLIFKQDDVKARVAALTVLAERYGQRKVRLVEWMSVLPIRPRGDDGKTLPDSAPYKAYSGGSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 654 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 655 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 656 - protein, 1348 aa, Finegoldia magna
MKSEKKYYIGLDVGTNSVGWAVTDEFYNILRAKGKDLWGVRLFEKAKTAADTRTFRSGRRRNDRKGVRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKQQLILLINDLLKIELEEEFMDSIFEILADVNEKKTEKKNILKELINAQDFNKQEGKILYSIFESIVTGKAKIKNIISDEDILEKIKEDNKEDFVLTGDSYEENLQYFEEVLQENITLFNTLKSAYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKYYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPIDTDVKLKLIEELFKKKTKVTLKSIRDYMIRNNFADKEDFDNSEKNLEIVSNMKSYIDFNNILGDKFELEMVEDLIEKITIHTGNKKLLKKYIEETYPDLSSSQIQKIINLKYKDWGRLSRKLLDGITGTNIETGEIDTVINFLRNSSDNLMQIIGSQNYSFNNDIDKLRKKYIPQEISYEVVENLYVSPSVKKMIWQVIRITEEITKVMGYDPDKIFIEMAKSEEGKKTTISRKNKLLALYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYKKSKIIPVKAILASDLRKDMNTLKSREVNDLHHAHDAFLNIVAGDVWNREFTSNPINYVKENREGDKVKYSLSKYFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 657 - protein, 1110 aa, Sphingobium sp. AP49
MAEGKKRIWRLGADLGANSLGWAAIELSAPVNGKPIAILAAGSRIFSDGRDPKSGASLAVDRRDARAMRRRRDRFKQRQKALIKYLIADGLFPADEAARNAMAAIDPYAVRARALDEALSLPELGRALFHLNQRRGFKSNRKADRKADDDAGKIAIGIDRTRDAIAEDEADAGAEPGSWTFGKWLHERRLKGQSVRTRLRPESGEDAKGDGYDFYPDRALMEEEFDAIWAAQAPHHPDVLTNDVHDRLHEIIFYQRPLKAPQVGMCSLIPGDRRLPKAHPLFQRRRLLEELNALMIVRPGEVAQRLTREERDILLLKLKDKNKVSFATLRKALKLDPDARFNKESEDRTDLKGDEVAAVMGSKTRFGNLWVHLSIEAQWDVLARLDAVESDAEDAAFCAWLVETYALTPEQARAVANAPLPPGYGRFGETATRKLIEALRDGKKDDRVLVYSEAVTEAGLGHHSDRRTGEVFEDAKGRPQLPYYGVALERHIMPGTGDPSDPEEMRVGRLTNPTVHIGLNQLRRILNVLIRAYGPPAEIAIELARELKLTDEDKKRINRENNDNRIAAERRSEKLLAIGQADSGANRALLKLWEELNPANVLDRRCIYSGRQISIDMLFSAAVEVDHILPFAATLDDSNGNKIVCLREANREKRKRSPHDAWGHSARWDEIAARAAQLPRNKRWRFEPDAMDKFRDEGGFQARHLVDTQYLARLSREYLATLYPEKGEGSGHIWVSPGRLTEMVRRKLGLNDLLPDHNFGGGADQAKNRLDHRHHAIDAVVVAIVDRGMLNAIARASGQEGAEGRERIIIPEPWDGFRDALRETVNRITVSHRTDHGTASKAGLPKGKDATAGRLHNDTAYGFTGDTDAKGNSIVVRRVPLSSFKKLADLDRIRDADLKAALYQHLNGLEGKAFEKALAEFHKLEWHNFGGVRRVRVTEPLTVIPIKDRNGRIYKGYKGDSNYRYDVWELPDGKWVTNWKNEAGEAMSSVISMFDAHQSSEPPRPHPAARKILSLHQNDLLAIEREGEDRKLMRVVKFGQSGQITLAEHQQAGDLKKRDAVSNDDDPFKYFAPTSGGLKKVKARQVRIDEIGRVLDPGFPARTARRKTRG

SEQ ID NO: 658 - protein, 995 aa, Campylobacter peloridis
MKILGFDIGINSIGWAFVENDELKDCGVRIFTKAENPKNKESLALPRRNARSNRRRLKRRKSRLIAIKHILAKELNLNYKDYIANDGELPKAYEGKLTNVYELRYKALNQKLEAKDLARVILHIAKHRGYMNKNEKKSNDSEKGKILSALKNNALKLEKYQSVGEYFYKEFFQKYKENTKNFIKIRNTKDNYNNCVLASDLEKELKLILEKQKEFGYSYNDDFIKEIINIAFFQRPLKDFSHLVGSCTFFEEEKRACKNSYSAWEFVALSKIINELKRLEKISGELISAQTINEILNHILDKGNITYKKFRSCINLHESIEFKSLNYDKDNAESAKLVDFKKLIEFKKALGEHSFNRQELDEIATHITLIKDNDKLKTALEKYNLNNEQINALLEIEFNDHINLSFKALNLILPLMREGKRYDEACEIVNLKSKTSNQKQDLLPAFCDSIFSQELSNPVVNRAISEYRKVLNALLKKYGKVHKIHLELARDVGLSKKAREKIEKEQKENKEINDWALDECEKFGLKANNKNILKLKLWKEQKEICAYSGKKISIEHLKDEKALEVDHIYPYSRSFDDSYMNKVLVFTKENQEKLNKTPFEAFGKNIERWNKIQALAQNLPYKKKNKILDENFKDKQQQDFISRNLNDTRYIATLIAKYTKEYLNFLPLNENENTNLKSGEKGSKIHVQTINGMLTSVLRHTWGFDKKDRNNHLHHALDAIIVAYSTNSIIKAFSDFKKNQELLKAKLYAKELTSDNYKHQAKFFEPFEGFREKILNKIDEIFVSKPPRKRARGTLHKETFYPEETMIKKYNSKEGLNIALNCGKIRKIGTKYVENDTMVRLDIFKKQNKFYAIPIYTMDFALGILPNKIVIAGKDKNNNPKQWQEIDESYEFCFSLYKNDLILLQKKDMQEAEFAYYNSFDIDSSRINIKKHDNKFENLTDNQKLLFTNQEKNRTGIQNLKIFEKYIVTPLGDKIKADFQPRQNISLKTSKKYGL

SEQ ID NO: 659 - protein, 1072 aa, Neisseria arctica
MSISHFRLKQLNYILGLDLGIASVGWAVVEIDTEENPTRLIDVGVRTFERAEVPKTGDSLAAARRQARSARRLIRRRTHRLLRARRLLKREGILHADDLNAEGLVKELPNTPWQLRVDGLDRKLMPKEWAAVLLHLVKHRGYLSQRKNESEGADKELGRLLAGVHENHQALQSSEYRTPAELAVKKFQAQSGHIRNQRGDYTHTFDRKDLQQELHQLFAAQQKYGNPFVSDGLKQGIETLLMQQRPALSGDAVQKMLGRCTFETEEFKAAKHTYSAERFIWLTKLNNLRIQENGNERCLTAQERGQIIDLPYKKAKLTYAQVRKELSLPENAFFKGLRYGKENAETAALMEMKAYHAIRKALEKAGLKTEWQGLACKPELLDAIGTVFSLYKTDEDISTRLQGQLSEDVINALLAGLNFDKFIQLSLKALSKILPLMEQGQRYDEAHAALYVRSTPQPQRLLPQITADEICNPVVLRTLSQARKVINAIVRRYGSPARIHIETGREVGKSFKDRQEIQKRQEDNHKERKQAAEKFLEYFPNFVGQPKAKDILKLRLYQHQHGQCLYSGKTLDICRLNEKGYAEIDHALPFSRTWDDSFNNKVLVLAGENQNKGNQTPYEWLGGASNSPRWQEFVARVGSSRFHHSKKQRILLRQLDEEGFKERNLNDTRYVARFLCKFIEENMLLLGRGKRRVFASNGQITSFLRSRWGLRKVREENDRHHALDAVVVACSTVAIQQRITYFVRQREMNIFDGELIDKETSEVSRPYFPQPWDFFRQEVMMRVFGKPDGDPSFPEADTKETLCTLLETRLSSRPQAVHEYVTPLFVSRAPTRKMSGQGHKETVKSAKLLHEGKSVLRVPLTQLKPNLLEKMVNRDREPQLYEALKERLAAYGNDPAKAFATEFRKKGGQLVKAVRVEDTQKSGVLLHKGTGVADNATMVRVDVFEKSGKYYLVPIYSWQVAQGILPNKAVIQGKDEKNWDEMDETYTFKFSMYPNDLVEINTGKQRLFGYYIGLDRATGAISIREHDLDNFKGKNGIYRVGVKTAISFKKYQTDELGKVVVPCRPKKRLPVR

SEQ ID NO: 660 - protein, 1130 aa, Streptococcus equinus
MSNGKILGLDIGVASVGVGIIDAKTGKVIHASSRLFSAANAENNAERRGFRGARRLTRRKKHRIKRVRDLFEKYEIVTDFSNLNLNPYELRVKGLTEQLTNEELFAALRTIAKRRGISYLDDAEDDSTGSSDYAKSIEENRRLLKNMTPGQIQLERLEKYGQLRGNFTVYDENGEAHRLINVFSTSDYKNEARKILETQSNYNKQITDEFIEDYIEILTQKRKYYHGPGNEKSRTDYGRYRTDGTTLENIFGILIGKCTFYPDEYRTSKASYTAQEYNFLNDLNNLKVPTETGKLSTEQKHYLVDFAKSSKALGVAKLLKEIAKIVECSVDDIKGYREDNKGKPDLHTFEPYRKLKFNLSLIDIDELSRETLDKLADILTLNTEREGIEDAIKRNLPNQFTEEQIVELVNVRKNQSSAFNKGWHSFSVKLMNELIPELYASSEEQMTILTRLEKFKVNKKSSENTKTINEKEITDEIYNPVVAKSVSQTVKIINAAVKKYGDFDKIVIEMPRDKNADDEKKFIDKKQKENAKEVEDALKRAAYLYNGTDKLPDGVFHGNKQLKTKIRLWYQQGERCLYSGKPISIQDLVHNSNNFEIDHILPLSLSFDDSLANKVLVYAWTNQEKGQKTPYQVIDSMDAAWSFREMKDYVLNQKGIGKKKREYLLTTENIDKIEVKKKFIERNLVDTRYASRVVLNSIQAALKELDKDTKVSVIRGQFTSQLRRKWKIDKSRETYHHHAVDALIIAASSQLKLWQKQENPMFVDYGENQVVNKETGEILSVSDDDYKELVFQPPYQGFVNTISSKAFEDEILFSYQVDSKYNRKVSDATIYSTRKAKLGKDKKEETYVLGKIKDIYSQDGFDAFIKRYKKDKTQFLMYQKDPVTWENVIEVILRDYPSEKLSEDGKKNVKCNPFEEYRRENGLICKYSKKGKGTPIKSLKYYDKKLGNCIDITPKGSKNEVVLQSLNPWRADLYFNPDTLKYELMGLKYSDLSFEKGTGKYHISQERYDEIKVKEGIGKNSEFKFTLYRNDLILIKDTESGEEELYRFLSRTMPNVKHYVELKPYDKERYDGGQELMKVFGNVANGGQCLKSLNKSNLSIYKVRTDVLGNKFFIKKEGDKPKLDFKNNKK

SEQ ID NO: 661 - protein, 861 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFLCCANLYYGFCFKSITK

SEQ ID NO: 662 - protein, 1099 aa, Corynebacterium
MSLSYRVGIDVGTYSLGCTAIEVDENDQPVKILSAVSLIHDSGLDPDQQKRAVTRLASSGVARRTRRLYRRRRKRMIKLEKFLKAQGWETLPFEHYSDPYLPWKARVELVNSFIHDDEERGRYLSIALRHIANHRGWRNPYWKVSSLYAPSEPSEAFQQIRKELEAATGRAIPHDATVGQLISFAQLGTDRLRGGGKKKDDKKPANEVKQAVISARLHQIDHAREINEICRVQKIDDTLRKNILDLVFEAESPKGAQQGRVGKDPLQPSQDRALKASDVFQQYRIAALTGNLRINRGGDTSPLDRDERLIVFNYLVNLSHKKEPTWLDIAELLRIDRGQLRGTAIMTDDGERAGARPPVHDTNRTILGCKVKPLAAWWERAADDERAAMLKSLSNAEVDDFDSPEGAQVQAFFAELDETEHEKLDSLHLPMGRAAYCEDTLKRLTSRMLDENLDLYAARLAEFNIPKDWTPPAPRIGEPVGNPAVDRVLKGVARWLEAAADVWGAPKSVVIEHVRDGFVSKSKANEIDRENNARHRRNQKLFQDMQEKLGIEGKPRSADLWRFQSVQRQNCQCAYCGEPITYSTCEMDHIVPRAGQGSTNTRDNLVAVCHRCNLSKKNFPFAVWAAQSGIPGVSVKEALDRTRHWAEDSGMSAKDFNKFRTSVRERLKRTAMDEPIDARSMESVAWMANELRGRVARRFQDNGTTVSVYRGALTAEARRASGISGQLRFIDGTGKSRLDRRHHAVDAAVVAFTQNYVAETLAIRSNKKREAELLRSAPQWKEFTGADEAHRAAWNAWLPKMRRLAMLLQQALDEDRVVVTSNLRLRIGNGRAHEDTIGELKKIRVGDAISATDIDRASTEALWCALTREEDFDPKEGLPENPERRIRVHGTWYDADDEIEVFPGRAGAIKVRGGYAELSRFHHARIYRIPGKKAPVFSMLRVYNVDLMQHRHEDLFSVEIKPQTMSVRQAEPKLREALSDGTAEYLGWLVVDDELVIDTSNFNTGQIAEVQSEFGQIQRWRLDGFDSNSKLRLRPLYMSAEGLPSDASQGSKKVIDTSGWRTAINKVFSQGNVTVIRRDALGRVRLTSKAHLPVSWRAE

SEQ ID NO: 663 - protein, 1395 aa, Treponema denticola; identical to SEQ ID NO: 163

SEQ ID NO: 664 - protein, 1035 aa, Gallibacterium anatis
MEQLNYILGLDIGIASVGWAVVEIDHNEDPIRLIDVGVRTFNKAEVAKTGESLSLIRRLARGSRRLVRRKKMRLLTAKRLLKSEGILSDLDFNKGAILNLPNNCWELRVKGLDKKLSDKEWAAVLLHIIKHRGYLSQRKHDRKTDDKELGALLSGVSKNHSLLEEGEFRTAAELAINVFCNSKGHIRNQWGDYSHTFSRLDLQKEIKQLFVSQRELGNPYTSSSFEENIISLLMKQKEAISGNDILKMLGKCTYEKNEYKAAKNTYSAERFVWLTKLNNLRIVDDGVERALNSSERKLLIDEPYKKAKLTYAQVRKILELPDSAVFKGVRYFADNAESSTLMEMKFWHSIRKALESNNLKDEWLVLKTKPELLDEIGTGFSIYKTDDDITSYLSNKLDKKVLDILLVEVSFDKFIELSLKCLRKIIPLMEKGYRYDEAYKYIYGEVNIEYNLNDIKNPVVLRSFSQSRKVINAVIRLYGSPARIHIETARDIGKSFKERKAIEKQQEKNRLEKVRAAEHFKQLFPNYVGEPKAKDILKVRLYEQQQGKCLYSGKILDIKRLMEHGYVEIDHALPFSRTWDDSFNNKVLVLANENQNKGNKTPYEWFNGKDNSDSWKRFLALVNNSGFSAVKKQHILMKEIDEEGFKQRNLNDTRYITRFLCNWVENNIPLLGKGVKRVFAPQGKITALLRSNWGIRKVREDNDRHHAIDAIVVACTTVSIQQRITNYVKNSEINRKIKRQNYLKFPEPWKFFREDISIRVFSNNPIEELKQQLSDRPEANHQFVTPLFVSRAPVRKMTGQGHEDTIRSAKRISEGISVLRVPLTKLNDKSLELMVNREREKELYDALKQRLLEFKNDPEKAFAEPFYKKGGQQVKTVRIERVQKNGVLVNNNTGIADNGNIVRVDVFLKKKKYFLVPIYSWQVAKGILPNKAIVAHKNECDWADMDGSAQFLFSLYTNDLIEVVLKDSTILGYFSSIDRATAALIIKEPDMEKSKGKEGIHRVGVKTARSFIKYNVDVLGKNISRCRKAKRLPVR

SEQ ID NO: 665 - protein, 1510 aa, Bacteroides
MKRILGLDLGTNSIGWALVDSEEQRILGMGSRIIPMDQGVLDTFSGGNPVETQTAARTVYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKSDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNHSKRTKLLLEEIPEKMIERQMNDTRYISKFVLPLLSNLVRAKENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNIKGISGL

SEQ ID NO: 666 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 667 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 668 - protein, 1226 aa, Mycoplasma mobile
MNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 669 - protein, 1381 aa, Streptococcus iniae
MHFKKVLAKRRKYMRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 670 - protein, 1448 aa, Capnocytophaga cynodegmi
MKHILGLDLGTNSIGWAVVKEAQNDNEQSEIVDVGVRVNPLTTDEKTNFEKGKPISTNADRTLKRSARRNLQRYKLRRKELIELLKEHQLISENTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQSHSDILTDEFYAQLKGKGQRATSALFLAKYQIYTAENKGSREDKKLQAYQWRVDALSKELTREELAFVITEINNNLNNSSGYLGAISDRSKELYFNNETVGEYLWKQIAANPHNSLKNQVFYRQDYLDEFEQIWKTQSAFYPEILTDELKKELRDVVIFYQRKLKSQKSLVSFCEFENKEIEIKNEDGTTTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSILEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGNLSTKAMREIITHLKQGFPFTGRKDRPDEPSACEFAGYKHSKHSLTKEENEKRVLKDSLEVLKKNSLRQPVVEKILNQMINLVNALLKKYRTENPNFKFDEIRIELARELKKKAEERANMTANINKAKTEHEKIIKILKNEFGLPNPTRNDIIRYRLYEELKDNGYKDLYKGDYIPREKLFSKEIDIEHIIPKARVFDDSFSNKTITYRKTNLEKGERTAYDYIESLGEKQLEEFLSRIENLYEIGKPSRLHNRRNPLKKVEEKGISDSKYKKLLKKESEIGDGFVERDLRETQYIAKKAKEILLQITRSVLSTSGGITDRLREDWDLINVMKELNLPKYRALGLTKMEDRKYGQQVEVITDWTKRNDLRHHAMDALTVAFTKHNHIQYLNYLNARKNEKHKEHNNIMAIQQLETIKVTDENGNEKRIFKAPMPNFRQVAKAFLENVLISHKAKNKVVTKNKNKISGNNKVQEVLTPRGQLHKETIYGKYQYYVQKEEKIGGKFDLETIEKVANPLYQSLLKKRLEENGGDPKKAFTGKNSLAKNPIYLDEAQTEQLPEKVKLVWLENSFSIRKDITPENFKDEKLIDKILDEGVKRILKERLQSFGNDAKKAFSDLEKNPIWLNKEKGIAIKRVTISGVANAEPLHTKKDHLGKEILDKEGKPIPVDFISTGSNHHVAVYRDEKGNLQEKVVSVFEAVVRANQGLPIIDKTYNQYLGWEFLFSMKQNEMFVFPNESTGFNPNDIDLLDPKNKKIISPNLFRVQKLATGDYWFRHHLETTVETKSATKDMTYKRLSLNHIKNIIKVRINHLGDIVSVGEY

SEQ ID NO: 671 - protein, 1029 aa, Alicycliphilus
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 672 - protein, 1450 aa, Elizabethkingia anophelis
MKTIMVKNILGLDLGTNSVGWALIKQDFENKQGDILGMGSRIIPMSQDVLGDFGKGNSISQTAERTKYRSVRRLRERFLLRRERLHRVLNVLDFLPEHYASQIDFNKRFGKFKEETEPKLAYSNDGFIFKKSFEEMISDFKTHQPELLENNKKVPYDWTIYYLRNKALSHKIEKEELAWILLNFNQKRGYYQLRGEEEEENPNKLIEFYSLKIVDVLADEPQKGKSDIWYSLILENGWIYRRSSKIPLLDWKGKTRDFIVTTDLNDDGSVKTDKEGNEKRSFRAPGENDWTLVKKKTEQEIDNSDKTVGAYIYEALLQNPKQKIKGKLVRTIERKFYKAELKQILEKQMEFHPELRQDDLYSDCVRELYKNNEAHQLTLSKKDFVHLFMEDIIFYQRPLRSQKSSISNCTLEFRKYKDENGTEHIQYLKALPKSNPYYQEFRIWQWMYNLNIYKKEDDTNVTKEFLNSKADFESLFEFLNNKKEVDQKALLKHFKINDKTHRWKYVEDKKYPCNETKTMISERLKKVENISDDFLTREMEQKIWHIIYSVNDKVKYEKALKSFAEKNNLDESSFFEAFKKFPPFKSEYGAFSEKAIKKLLPLMRLGKYWDDDEILKYSDIYFKNIEYLLGVLKQKDKNISDDNRQNWNKSINNKLREELEIFQNAEIESFQGLRLHIAQYILYGRHSEAAMLGKWNSADDLEEFLKEFKQHSLRNPIVEQVITETLRVVKDIWVKYGNGAKDFFNEIHIELGREMKLPAEDRKKITNQISENENTNLRIKALLAEMMVDSSVENVRPFSPMQQEILKIYEDGVLNSDIEIEDDILKISKTAQPSPSDLKRYKLWLEQKYKSPYTGQIIPLNKLFTPEYEIEHIIPQSRYFDDSFSNKVICEAAVNKLKDNFIGLGFIKQFGGTIVECGNGKSVTVLKEDQYEDFVKKHYANNRSKRNKLLLEDIPEKMIERQMNDTRYISKYISGVLSNIVRTEDGTDDGVNSKNIVPGNGKITNTLKQDWGLNDIWNDLILPRFERMNQLTNSTDFTAWNENHQKFLPTVPVEFSKGFSKKRIDHRHHALDALVIACATKDHVNLLNNQSAKSDTKRHDLKRKLMKFEKVAYNHPQTGERIEREVPKQFLKPWETFTVEAKNGLETIIVSFKQNLRVINKATNHYEKYVEKDGAKVKGRVEQAGTNWAIRKPMHKETVSGKIDLPRIKVPKGKILTATRKNLDTSFDLKTIGSITDTGIQKILKNYLQYKDNNPELAFSPEGIEDMNKNIEKFNDGKVHQPIIKVRIFELGSKFPLGQSGNKKDKYVEAAKGTNLFFAVYEDKNGKRSYETIPLNEVIERQKQGLTVVDLKGVNDFYLSPNDLVYVPSEDELENVSMIDYNKLSNEKVYKVVSFTGNQIFFVRQDVATSIVNKAEFSSLNKMERAIGGTMIKEVFVKIKIDRLGNISKV

SEQ ID NO: 673 - protein, 981 aa, Sphingomonas sp. SRS2
MRCQLPVSAASATLQKRGGRMRRLGLDIGTNSIGWCLTEDDSRIVDIGARIFSDGRDPQSGTSLAVDRREARAARRRRDRYLGRRSSFLEALVAHGLMPDDADEAQMVAQRDPYPLRARALDEKLAPIEIGRVLFHLNQRRGFKSNRKAERKSGDNEEGKIASAARGLDEAMAEAGTDTLGQFLAGLETKRVRMNGENQTYDFYPQRRHIEYEFGRIWEEQAKHHPTLLTDAARAELHRILFFQRPLKEQAIGICTFVHNEFRLARAHPLFQERRLYEEVNQLEITTPGAPNRKLKMDERDRLILKLRGVRAANFESLGRLLKLEPGQSFNKASETRTQLAGNEVHATLSDKKRFGNSWEHFDRARQWKIIERLMEEENPDTLHEFLTGECGLDDERADTTAKASLPEGYGRLGINATSRILDELKKEVITYAEAVGRAGWHHTDNRTGEILSQLPYYGELLTRHIPPGTQDPNDPPEKRWGKITNPTVHIGLRQLEKLMNAIITLHGRPNEIVVELARELKLNEKDKEEHNRRIRRDTAAAQARSKKLETEGFVDNGANRALLRIWEELNPANPLDRRCPYCGEPIGMRMLFSGEADIDHILPYSRTLDDSIGNKSEGNVYVIPGRMTAMLRRLWGLNSLLPDHNIVENKHSDAPKNRLDHRHHAIDAAVVAVTTRGLMQRIARTAGLAEDRNLDRLFEGLDQPWAGFREELGERLSAVVVSHKPDHGRKGRPLPGKDMTAGRLHNDTAYGLTGEVNAKGVPVVVHRVPLMSLKSTDLTDPDRIADKALRDALYRATEGSTGKDYEAALVRFAKQDRVFGGIRRIRVREPLNVITIKDQSGRVYKAYKGDANARFDVWQLPGGKWVSDVVPMFDAHQVGQADRRPHPAARKILSLHQNDMLAIERNGGPREIVRVVKFSTNGSLHLAPSTEAGPLKARDATPSDVDPFKYINSSAGGLKRVQARQVRVDPLGRIFDPGPR

SEQ ID NO: 674 - protein, 1342 aa, Lactobacillus salivarius
MEDMERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 675 - protein, 1443 aa, Porphyromonas gingivalis
MKKILGLDLGTASIGSAYVLEAEKSADQTKIVYLGTRIILSSADAENFSKGLSCSPTTDRTFKRSMRRRLQRYKQRRSSLIQQFKKIGIITNTEQIIREPISETHELLRIRSKAVSEHVSLEEFARILLTINKRRGYKSNRKTSKSTEEDGKLVDAMAVTKELIKLKKTPGQYMFERFKRGKYAEIDFYPFDLINELKQIWEVQGQKYPDVLTEGLLSSLLKQKTGKAKELIYSKSDLNPAEVPIDYQKGKKLRKTILNKYFAYESRSLAVTNIIPVEQAITAIVAICKQINNSSGYLGAIGDRSRVLYANNQTIGQYLYERIKANPHDRIRGEVFYRQDYLDEFDRIWECQQNYYPAILTNDRKQYIRNRIIFYQRPLKSKKSELAFCEFESREVEHNGKKYTEGLHVAPKSSPVFQHFRLWQRLGQIEVSPLRKWDKQSNELFEQQNNADREGILNTEAKQKLFSYLNLLDHLTDNEILNILGYSPDKWKINFREIIGNRTNNLMMKAFFSMKEMTDGEQIDWEKNLTKITNGQSLISPEQIVDLIRQFFEREGITTSLLYFDPATDNFREQSHYSLWHLLYSYEDDNSPTGTTSLCKTLAKRYGIPHELCPLLASLTFERQYGSLSTKAMRKLLPFMQEKRYDEACELAGYRHSAWITKEENAKRTLKNKLPLLRKGSLRNPVVEKILNQMTHVINTHIAEYGNPDEIRIEMARDMQANSKQRKAMTAAITEATKRNTQFIEEIQKEFGFNPSKNDLIKYKLWKELAPLGNKTLYSNIYIPKEELFTAKFEIEHIIPRALFYDDSFSNKTLELNSVNKLKGNKTALDYLDTLGQEKANDYILRVEELKKIGAITQAKYKKLLIREKDLGDDFTNRDLTNTRYIIRHAADRDLTNTRYIIRHAADMLLQVTPSIVHTNGSITAILRRDWGLLDILKELNLPTYESIDRKISDPEEKLTQSVDRKDGQAIKMIKDWSKRDDHRHHAMDALITALTTRKHVQYLNGNSGAEETDKAQKLEQLKALRKQLIGSDGHFIPPMHDIRVQAKEALSRVIISTKVKGKVTTPNTNIICSRDKTTGRKIYVRQTTLTPRGALHLDTKYGINRYYQEREVSIGSKLTQEEIRLVSSPHIQSILLERLRAFDNNPKSAFTGRNSVDKKPLEDKNKKLVYTDKKVKQTILANRFVKRDRVNSKLDLDNVIDTGIKRILERRLKQYGGKYETAFSDLENNPIWLNEEKGIAIKSVRIRGKNNTITIRQTNTCRIKYVANDNNHHLAVYALPDGSIKDDIVSFFDAVERSRKRLPIIDKHKNQSLGWKYLFSIKQNEYFLLPQQVEKIDIDTGEISMQTTFSPKDLSHEYIMNPDNYAELASHIFRVQSISKTPQGNRDVRIYLFKQQYISGSQKDSLHLKGITHRQISSAKDLAELVKIRVNHLGRIVSVGEK

SEQ ID NO: 676 - protein, 1095 aa, Actinomyces sp. oral taxon 175
MPAHHLRVGIDVGTHSVGLATLRVDDQGTPIELLSALSHIHDSGIGKEGQKDHDTRKKLSGVARRTRHLLRNRRERLQQLDKVLVDLGFPIPKPEEYPDLSERTDPYRVWRVRARLVEETLPEELRGPAISMAVRHIARHRGWRNPYSKVESLLSPAEESSFMKALRKRIMTKTGEVLDDDITPGQAMAQVALTHKIYMRGPEGILGKLHQSDNANEIRKICARQGISSDVCKQLLRAVFKAESPRGSAVSRVAPDPLPGQGSFRRAPKCDPEFQRFRIISIVANLRISETKGENRPLTVDERRQVVAFLMEDSQADLTWVDVAEKLRVSRQALRGTAMLTADGERSAAQPPIDVTDQIMRKTKISALKTWWDKADAERRGAMVRYLYEGLEDSECAEVIAKLPEKDHAKLDSLHLPAGRAAYSRESLTALSDHMLETTNDLHEARKRLFGVDDSWAPPAEPVGAPVGNPSVDRTLKIVARYLSAVESIWGTPEVIHVEHVRDGFTSERTAEERDKANRSRHNDNQKAIEKIQHDYGKEGYISRGDIVRFHALKLQGSACLYCGTTIGYHTCQLDHIVPQAGPGSNNRRGNLVAVCERCNHSKSNTPFAVWAQKCGIPHVGVKEAISRVNGWVEHNHSTSSGDLTRLKKEVIARLRRTQKDPEIDERSMESVAWMANELHHRIAAAYPETTVMVYRGSITAAARKAASIESRINLIGEKGRKDRLDRRHHAVDASVVALMEPSVAKTLAERSSLRGEQRLTGQEQTWKQYTGLTVGARERFEAWRGHMHRLTELFNESLAADEVYVTQNIRLRLSDGSAHTVKASKLVSHRLGDGLTVQQIDRACTPALWCALTREIDFDEKNGLPAREDRVIRVHGQEISSADCIQVFSKRKKTKSDRDEAPFGAIAVRGGFVEIGSSIHHARIYRIEGEKPAYAMLRVFTHDLLSQRHGDLFSAVIPPQSISMRCAATELRQAISEGRATYLGWIVSGDELHIPVETFTTHKIGSFLKDYPNTTRWRICGYDSETMLILKPRILSAEGLNNSSDIAEYVIKNKGWRVAINKLAKVHPTVVRRDALGRPRHSSRSNLPVTWSIE

SEQ ID NO: 677 - protein, 1095 aa, Sphingomonas
MDGGAMDWRLGLDLGANSLGWAALRLDRAGDPIGILAMGSRIFSDGRDPKSGASLAVDRRAARAMRRRRDRFKQRQAALLKYLIRDGLFPADQADRQRLADEDPYALRARALDEELSLFEIGRALFHLNQRRGFQSNRKADRGQDDEAGKIAVGVDRLNQQMEEQGARTLGEFLHQRRRAATDANHIPSVRTRLRPETGEGAKGDGYDFYPSRALIAEEFEEIWAAQAPHYPDTLTQQVHDRLYEIIFHQRPLRAPQVGQCTLVAGETRLPKAHPLFQKRRLLEEINALMIVRPGEIAQRLTPEERDTLYLKLKDKRTVSFATLRKTLKLDSAARFNKESENRTELKGDEVAAELGAKTRLGTRWQHLSGDQQWEVVHRLMALESQADEAAFRDWISQTYDLLPEQAAAVLGARLPQGHGRFGPTATTTLIDSLLHDRTEDGRVVVYSEAVQRSGLGHHSDLRHDRDDEDVTELPYYGVALERHIMPGTAEPTDPEEMRIGRLTNPTVHIGLNQLRHVVNRLIRAYGPPKEIAIELARELKLSEDEKKKRNSENRDNRLAAEGRSKKLEEIRQRDTGANRALLKLWEELNPGNVLDRRCIYTGEQISIDMLFSDRVEVDHILPFAQTLDDSNGNKLLCLREANREKRRRSPYEAWGHTDRWPDIAERASRLPKPKRWRFEPDAMQRFATEDGFLARHLVDTQYLGRLAREYLSWLYPGRGEGSGHVWVSPGRLTEMVRRKLGLNDLLPDHNFGGGADQPKNRLDHRHHAIDALVVAIVDRGMLQAIARASGQDGSEGRERIHIPAPWDGFRDDLRVAVNGIIVSHRPDHGTVAKAGLARGRDQTAGRLHNDTAYGLTGETDAKGNSIVVRRIPLSAIKKPADIARVRDPLLRNALAEFTKGLDGKAFEARIGRFHELGPLLYRGIRRVRVVETLTVIPIRDAEGRAYKGYKGDSNYRYDVWEMPDGKWRCQVVSMFDAHQSTEQARPHPAARKILSLQRNDILAIERTEGDRELVRVVKFSEKQFAVAPPHEGGSLKTRDGNADDPFRYLYPSPNTLKGWRARQVRIDELGRVLDPGFPARKSVRRTRPRAAPVD

SEQ ID NO: 678 - protein, 1345 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 679 - protein, 861 aa, Acholeplasma palmae
MKKILGLDVGVTSVGWAIIDEEGNIVKTGVRLFEEASAKNNLDRRTFRGQRRLIRRRNQRIDDMRSLLIKNLLIDNQFKVLDNPYQLREKGLKEKLNHEELATVLLHYAKRRGSSLEVVEEEGIKKETSTKSILNENAKELKEKQYVVNVQLNRLKKEGKLRGNINNFKTKDYAKEIITLLDNQNLDSELKKEIIEIIQRRRHFSEGPGNFNSPTPYGRYREVTGTLKEKIIKDIHANYRKQYLNSNFSIVFDDIEYQVFKNGRIVNKEKYDLIDLMRGKCSLYPDQPRSPKMAFSAEIFNLLNDLNNLKILNRENNKITKEEKITIINHVREKGSITVQQLLKILNAQQEEIKGFRIDKNEKPIITEFKGYKKILKVYKELDITIDSDEILDRIIEILTQTLVEEERILSLKKEKINERLIEPLSLLTGIKEYHSLSLKAIYQLNKEMLEESLNQQEIITNWGIKNDDTIKELVLDESLILSPVAKRAHREALKLVNQLIKEEGNFSKIVIETTRSKNSLDEIKEIKELQKNNENNRRQAEEIIGDRAKELVNSSNILKLRLYNEQNGKCAYTGEALSIDALLNDPNIYEIDHIIPISISFDDSYANKVLVTRSANQKKGNKTPFGYFSKADLVANSKINSWNMFKEIVLLNKNYSIRKKQNLLFEEDITKHSVVSDFINRNLVDTSYAIRSLMTTLKNYFKSNHVDTTIMTIKGKQTNYFRKTGMIAWSRKHPKRENPFRKDRNKYIHHAIDALIIAGLSNRKYITKLYNLSQEIDIETGELIEYIDASEDSKLIQYLLKVGEVQEEDVKFSWKIDSKPNRSMMNQTIYSSRILGGESLLLSKIDIYNSKKEDFIKKNY

SEQ ID NO: 680 - protein, 1074 aa, Bacillus pseudalcaliphilus
MGYLDYRIGLDIGTNSIGWSIIELTTVQSKLDGKYRLKAVGLIDAGVRMFDRAEVPKTGASLALPRRLARSSRRRLTRRSARKKAIRNLLVKEDILNQIELDHLYRTSELVDIWQIRVEGLERRLGRQEWARLLIHLGQKRGYRSTRKAEEGADTEGRAVLSSIKENQETLKQYRTVGEMWATDDKFKGRVRNSTNEFIFNVSRDNLEEEIRFLFQQQRELGSMYASKLLEESYMEVWGHQLPFASGESILKNVGTCSLYEKEKRAAKATYTFQYFMALDKLNNVRILPSMRTLSEEERGLALKAMFERDKLPKNPPKFTYSHLRKAIKLEEDETFQTISYDVEKTLATNESAVFVNLAAYYQIKKVCDEHNENYDYVDYNTIGHALTVYKTDEDINKYLASKNNIAKRVYANDFIDSVLKHSYTTFGHLSLKALSRIIPLMEEGEVFAKAKEKAGFKEESYLEIKSKLLTNIPDAIKNPVVMRSLTQARKVINAIIKRMGEQPASIQIELARELSKDVSERKKITNGFAENRSRNQFAIKTLEENHITNIRGQDIVKFKLWQEQGGRCAYSLKPIKLEELISFLKKERRYEHNLDVDHIIPYSKTFDDSYTNKVLVFSDENRKKGDQIPAEYLGIGTKRWEKYKEFVITSKFPASKKKRLLKEQLVEREELFMKERHLNDTRYASRYFMNFLRENLLRKETVLHETQWVTAVAGRVTSHIRKRLGFGKDREETHLHHALDAIIVACTDKWMIDCVTNYYKSREGGSIKRKEIRFPSPWNGFWHDVQTKLAQLPQPEVINESISKGNPDAVDYMLVSRMPRKSITGAAHKETISKWGGYDDKGKALLVKKVALSELKFKNDDFPMYNKETDPLLYEAIKNRYVESGRDVKRAFATPLYKPSKSGKRNEVKRVKVIAEKKAMVREVNGGIAENGGLVRSDIFLKEKKYVMVPVYTFDTIKQQLPNKYVVSGRGYEQWPELTAEHVFQFSVYPYELVHVGTNKGDNSFYYFASLNISSNVLKFSECNRPTKDYIEIGLNSIILLEKYEIDVLGRITGQSKKGIRQSFKNNKSQMKE

SEQ ID NO: 681 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 682 - protein, 1367 aa, Fusobacterium periodonticum
MKKQQFSDYYLGFDIGTNSVGWCVTDFNYNVLRFNKKDMWGSRLFDEAKTAAERRVQRNSRRRLKRRKWRLNLLEEIFSDEILKIDSNFFRRLKESSLWLEDKSSKEKFTLFNDDNYKDYDFYKQYPTIFHLRNELIKNPEKKDIRLVYLALHSIFKSRGHFLFEGQNLKDIKNFETLYNNLMAFLEDNDIYKNIDSSYIGNLENIICDSKKGLKDKEKEFKEIFNSDKQLVGFFKLSVGSSVSLNDLFDTDEYKKGEVEKEKISFREQIYEDDKPIYYSILGEKIEFLDIAKSFYDFMVLNNILADSQYISEAKVKLYDEHKRDLKNLKYIIRKYNKENYDKLFKDKNESNYSAYIGLNKEKGKKEVIEKSRLKIDDFAKIIKGYLPKAEKIDEKDRSIFNEILDKIELKTILPKQRISDNGTLPYQIHEAELEKILENQAKYYDFLNHEENGISTKDKLLMTFKFRIPYYVGPLNSYHKNKGGNSWIVRKEEGKILPWNFEQKVDIEKSAEEFIKRMTNKCTYLNGEDVIPKDSFLYSEYIILNELNKVQVNDEFLNKEIKKKIIEDLFKKSKKISEKNFREYLLVNQITNKTVELKGVKDAFNSNYVSYIKFKDIFGDKLNLDIYKEISEKSILWKCLYGDDKKIFEKKIKSVYGDILTKDEIKKINSFKFNTWGRLSEKLLTEIEFIDLETGECYSSVMDALRRTNYNLMELLSSKFTLQENIDNENKEVSEFSYRDLVEESYVSPSLKRAILQTLKIYEEIRKITGRIPKKVFIEMARGGDETMKNKKIPARQEQLKKLYDSCGKDISNFSIDIKEMKNSLNSYDNNSLRQKKLYLYYLQFGKCMYTGKEIDLNRLLQNNDTYDIDHIYPRSKVIKDDSFDNLVLVLKNENAEKSNEYPLKKEIQEKMKSFWKFLKEKNFISDEKYKRLTGKDEFELRGFMARQLVNVRQTTKEAGKILQQIEPEIKIVYSKAEIASSFREMFDFIKVRELNDTHHAKDAYLNIVAGNVYNTKFTEKPYRYLQEIKENYDVKKIYNYDIKNAWDKEKSLEIVKKNMEKNTVNITRFIKEEKGQLFDLNPIRKGETSNEIIAIKPKFYEGSTEKLNEKYGYYKSLNPAYFIYVEHKEKNKIIRSFERVNLVDVNKIKDEKSLIKYLIENKGLIEPKVIKKVYKRQVILINNFPYSIVALDSNKLMDFENLKPLFLERKYEKILKNAIKFLEDNQGKTEEYYKFLYLKKKDRNEKNETIDSVKERYNIEFNEMYDKFLEKLDSKDYKNYINNKKYSELVNVKEKFIKLNLFDKAFTLKSFLDLFNRKTMADFSKVGLTKYLGKIQKISSNVLSKNELHLLEESVTGLFVKKIKL

SEQ ID NO: 683 - protein, 1055 aa, Saccharibacter sp. AM169
MTPISESLLFGLDVGISSCGWAVLKHSDTTGHIEALGSWCFNAPETKTERTPTNQIRRSSRLLRRVVRRRRNRMTEIRRLFARHGLIDNDRPDALRQPAIDPWEMRGQGLDRQLTPEEFAVALAHIAKHRGFKSSAKRVKSNASPDDSKMLAALEKTKELSAQYRTIGEMFARDSAYVQRRRNRDGLFDRTISRDDLIDEAKILFDRQRKLGNPVASTEIEEAFTRIAFWQNPMQDSGVLVASCPFEPKEKRSSRFSPSFERFRLLCRLINLRVTDGPEERPLTEEELRLAYEHAGKTRKLTAAAIRKLIGLRDDQHFTTIPPEQEKQDITSRTGETFAGTATFRSVLGESLWRQLLPHPEWLDNAAWIISFHELTETIIKKLGEIGLPVEAYELICDALKSDKSPFAKFKGASSLSDKAVRALIPYLQQGLTYDKACQKAGYDHAASRFSGRATIDTKAKFNALMAEVRDSIANPIARKALSEGMKQLWAMRNRWGLPGAICIELARDVGNSLEKRKEIERNLKTTAKQRAREREEACELLNLKEVSSDILLRYRLWKEQGGRCCYSGKSITPDMLMAQDNRIQIDHILPWSRFGDDSYSNKGLCLAKENQAKKNQTPYEWIHGQGTTAQKEQWDKFVADVESRKNTKGLKKRNFLLKGSKEIEERFRSRNLNDTRYAARLMVEAARLLYPAGQRGEKGGTRRVFTRPGALTAALRHAWGVESLKKIDGERLHDNRHHALDAAIVAAVSEAEIQKLTKSFQECEQKGLSRPMRDVAPPWDGFRDQLKEKYETIFVARPERQRARGQGHEATIRQVREEETGPVIYERKAVSALTLADLAKIKDPDRNAGLIASLRQWIEAGKPADKPPRTPCHQSAAGHEIRKVRLATIITPAVPVRGGMAKRGEMTRVDIFKVIGKKGKPEWYMIPIYPHQIMNRSQWPAPPNKAVVAGKSEADWPIMGAEAQFQFSLYPCSYVRLFKEGTVIEGYFCGCHRSRAYITLALSTGAAPLQKGIGIKTQEHIQKFSVNRFGELSPVKQETRTWHGVACTSPDQHD

SEQ ID NO: 684 - protein, 1104 aa, Lactobacillus shenzhenensis
MGYILGLDIGIASCGYAILETDALGIPFKIKMLNSVIFTRAENPKNGASLAEPRRRYRGARRRKRRTSFRKHRTRQLFIREGLLTQQDITAYLNQEISHDDIWQLRVAALDQRITSRQLFQVLYYFVTHRGFKSNRKAELTDKDNGPVLKSISAFETEMTENGYRTIGELYAHDRRFQDRKHNKGYTDGFIGTVKRAWLVDEIKRILAAQQSLGNDKITDKFVHQYLDIFESQRNYDVGPANGPYAGDLIAKMVGPDTFDRSRKRSPRATYTFQYFNFLTKLNSLRVADSIGGTYAPLTDDQRQTVTERLWAKGVKSADLTFKQIRALLSLPDGARFNLVTYSGDAKKALEIEGKTKFVSVKPLRDIQKALDDEQLANDHELLDAIALVLTLYKSDDKRRTKFHEQTTLPDDKIEQLLPLNFAKFGHLSTHTMQAIIPYLEQGMVYSDAATAAGYDFRDNQIDMEYIRENVTNPVVRRAVSVANKLVKAVVRRFGKPDSIHIELARDLSKNFQERKQEEQYQKKNAAANEKIAQQLKELGIPVNGMNITKMRLFNEQNGIDIYDLTPNASMAVTDIFSDDLYEIDHIIPYSISFDDSYSNKVLVSAKANREKRDRIPMEFFGNDPKTRAQFVNRVNTNIHNAKKKRNLLKETLTDEDKSQWKSRNINDTRYLNRILMNYLSQNVEFTDVLSKAKHVIALNGAVTAKIRSRWGITKVRVAGDLHHAVDAVVIACVTDGLIQAVTRYAKYQERKGNKLASLDDLQDDNPDGLDAKRFRKLFNDYPLPWPEFREELHGRVSDAPDKLMAGHPWAHYTPEEIAGLQKPFVVRVPNHRIVGPATLDTVYGQPDPDSNIITQRVRITDLKLKKSKNGDDTIAAGTNAYALAEDGGNKVVYETILRALQAANGDGKKAFPEGRVMVKMPNETIPVERVRVTGKATSTVPVGPKSVAANGSMVRIDVYKTPKKYVFVPVYVKDTVNENLPKKAATQRKSLADWYEIQPQDQFEFSLFANDLIHIVNKKGIKTTEINADGMSTNGIREEIVGYFTGADIATASIAFDGPDRSFSARSVGFATLDKVEKVSTNYFGELAVVHETQPLGFTNKGD

SEQ ID NO: 685 - protein, 1378 aa, Pediococcus damnosus
MTNEKYSIGLDIGTSSIGFAVVNDNNRVIRVKGKNAIGVRLFDEGKAAADRRSFRTTRRRLSRRRWRLKLLREIFDAYITPVDEAFFIRLKESNLSPKDSKKQYSGDILFNDRSDKDFYEKYPTIYHLRNALMTEHRKFDVREIYLAIHHIMKFRGHFLNATPANNFKVGRLNLEEKFEELNDIYQRVFPDESIEFRTDNLEQIKEVLLDNKRSRADRQRTLVSDIYQSSEDKDIEKRNKAVATEILKASLGNKAKLNVITNVEVDKEAAKEWSITFDSESIDDDLAKIEGQMTDDGHEIIEVLRSLYSGITLSAIVPENHTLSQSMVAKYDLHKDHLKLFKKLINGMTDTKKAKNLRAAYDGYIDGVKGKVLPQEDFYKQVQVNLDDSAEANEIQTYIDQDIFMPKQRTKANGSIPHQLQQQELDQIIENQKAYYPWLAELNPNPDKKRQQLAKYKLDELVTFRVPYYVGPMITAKDQKNQSGAEFAWMIRKEPGNITPWNFDQKVDRMATANQFIKRMTTTDTYLLGEDVLPAQSLLYQKFEVLNELNKIRIDHKPISIEQKQQIFNDLFKQFKNVTIKHLQDYLVSQGQYSKRPLIEGLADEKRFNSSLSTYSDLCGIFGAKLVEENDRQEDLEKIIEWSTIFEDKKIYRAKLNDLTWLTDDQKEKLATKRYQGWGRLSRKLLVGLKNSEHRNIMDILWITNENFMQIQAEPDFAKLVTDANKGMLEKTDSQDVINDLYTSPQNKKAIRQILLVVHDIQNAMHGQAPAKIHVEFARGEERNPRRSVQRQRQVEAAYEKVSNELVSAKVRQEFKEAINNKRDFKDRLLLYFMQGGIDIYTGKQLNIDQLSSYQIDHILPQAFVKDDSLTNRVLTNENQVKADSVPIDIFGKKMLSVWGRMKDQGLISKGKYRNLTMNPENISAHTENGFINRQLVETRQVIKLAVNILADEYGDSTQIISVKADLSHQMREDFELLKNRDVNDYHHAFDAYLAAFIGNYLLKRYPKLESYFVYGDFKKFTQKETKMRRFNFIYDLKHCDQVVNKETGEILWTKDEDIKYIRHLFAYKKILVSHEVREKRGALYNQTIYKAKDDKGSGQGSKKLIRIKDDKETKIYGGYSGKSLAYMTIVQITKKNKVSYRVIGIPTLALARLNKLENDSTENNGELYKIIKPQFTHYKVDKKNGEIIETTDDFKIVVSKVRFQQLIDDAGQFFMLASDTYKNNAQQLVISNNALKAINNTNITDCPRDDLERLDNLRLDSAFDEIVKKMDKYFSAYDANNFREKIRNSNLIFYQLPVEDQWENNKITELGKRTVLTRILQGLHANATTTDMSIFKIKTPFGQLRQRSGISLSENAQLIYQSPTGLFERRVQLNKIK

SEQ ID NO: 686 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 687 - protein, 1137 aa, Bifidobacterium tsurumiense
MGIMYRVGVDVGLNSTGLAAIEVDSEGKPIRILNMQSVIHDGGVDPNSNKTGDTRKLISGIARRTRRMRRRRRARLAKLDHFLSELGLPIEEYGDESFEPWVVRAKLADAYIEDEETRKRFLSIAFRHIARHRGWRNPYKSVQSLYDLNVDDLSKQYESLCSSGGCDKEDGLTPAQIAVEYVRANAGNPAPRFRKSTNQKYSNNQTLFPQRLMQEDNAYEVSYICQQQGIDEDTEHSIISKIFDSKSPRGSAKDRVGKDVLTGEPRALKASLAFQRFRIIAALSNISIKVDGVVRPLNISEKQRAFNVLADMDVKDRPTWSDVAQSLGVTRREIRGIGGIQDGEDRVSNRAPVVESYFALRDAEGALKKLVVKVILPWWNEASDQEREHLIELLSNTIDIDSVRDDLDYASAFDLIDSFDDEALAQLDNLKLPSGRAHIQCGPALTWRIVYSTHPITCMRRANTCMGVTDNWRPPQEPIGKPVGNPSVDRVLKIVNRYLMNVTNRWGRPVSVNIEHVRDGFSSLKVARMYQRDTEQRAKYRDSIFQEMKREDPKIDRYQDSQIKRWEAVQRQGSKCLYCGSLIDFSSCELDHIVPRKGVGATNTKTNLAAVCANCNRNKSNTLFSRWCHSDYASEHGITLKAALERVDSFLFPAGMYNRRESLNFMRAVKARLQQKTEDEAPDNRSIESVAWMADELHKRIDWYYNSERYLSRDTENLPDRQVEVFVYAGKVTAMARRFSGIEKQIHFAGPHGKTRLDRRHHAVDAAVIALMHHGMAMILNEKNELRMAQFYTNQLNQNEMDWKEYPAGTSKGPRYFEWVDDMHSLLELINNALDADRVKVLRNIRLELGNSRAHKDTIHKLVKVRLGDALDAKQINKASTPALYAALTRLPEYNPKNGLPENSDREITVNGKHYAADDDVLFFATDAAQLMVNGGSVEIGDGFHHARVYKCAKFNKAGKQTGFFYGMIRVFAADLVHAAHEDLLSAELPPQSLSMRYGEKRTVDAILSGHAEFVGHLFIGDEIRLNLGKVNYTGQVKEYEEVLRDSSSPHIYSSWVIDGYYSPSRLRLRPLFLSSEGIDKMPIEQQGVLGKMFKPGWLPAVDVLSSFEPEVLRRNGLGEPRWSSNSGLPVSYRWRE

SEQ ID NO: 688 - protein, 1107 aa, Eubacterium ventriosum
MGYTVGLDIGVASVGVAVLDENDNIVEAVSNIFDEADTSNNKVRRTLREGRRTKRRQKTRIEDFKQLWETSGYIIPHKLHLNIIELRNKGLTELLSLDELYCVLLSMLKHRGISYLEDADDGEKGNAYKKGLAFNEKQLKEKMPCEIQLERMKKYGKYHGEFIIEINDEKEYQSNVFTTKAYKKELEKIFETQRCNGNKINTKFIKKYMEIYERKREYYIGPGNEKSRTDYGIYTTRTDEEGNFIDEKNIFGKLIGKCSVYPEEYRASSASYTAQEFNLLNDLNNLKINNEKLTEFQKKEIVEIIKDASSVNMRKIIKKVIDEDIEQYSGARIDKKGKEIYHTFEIYRKLKKELKTINVDIDSFTREELDKTMDILTLNTERESIVKAFDEQKFVYEENLIKKLIEFRKNNQRLFSGWHSFSYKAMLQLIPVMYKEPKEQMQLLTEMNVFKSKKEKYVNYKYIPENEVVKEIYNPVVVKSIRTTVKILNALIKKYGYPESVVIEMPRDKNSDDEKEKIDMNQKKNQEEYEKILNKIYDEKGIEITNKDYKKQKKLVLKLKLWNEQEGLCLYSGKKIAIEDLLNHPEFFEIDHIIPKSISLDDSRSNKVLVYKTENSIKENDTPYHYLTRINGKWGFDEYKANVLELRRRGKIDDKKVNNLLCMEDITKIDVVKGFINRNLNDTRYASRVVLNEMQSFFESRKYCNTKVKVIRGSLTYQMRQDLHLKKNREESYSHHAVDAMLIAFSQKGYEAYRKIQKDCYDFETGEILDKEKWNKYIDDDEFDDILYKERMNEIRKKIIEAEEKVKYNYKIDKKCNRGLCNQTIYGTREKDGKIHKISSYNIYDDKECNSLKKMINSGKGSDLLMYNNDPKTYRDMLKILETYSSEKNPFVAYNKETGDYFRKYSKNHNGPKVEKVKYYSGQINSCIDISHKYGHAKNSKKVVLVSLNPYRTDVYYDNDTGKYYLVGVKYNHIKCVGNKYVIDSETYNELLRKEGVLNSDENLEDLNSKNITYKFSLYKNDIIQYEKGGEYYTERFLSRIKEQKNLIETKPINKPNFQRKNKKGEWENTRNQIALAKTKYVGKLVTDVLGNCYIVNMEKFSLVVDK

SEQ ID NO: 689 - protein, 1397 aa, gamma proteobacterium HTCC5015
MTKNYISPIAIDLGAKFTGVALYQYLEGADCTQEVAKGLLVDDRGNVTWSQEGRRGKRHQVRGYKRRKMAKRLLWLILDSEYGIKREEVTEPLLKFINGLLNRRGYTYISEEVDEESMNVSPLPFSEMMPDYFNSSAPLLEQLAKLLSDKNKLVRFRAEGKIPSNKNEFKKLLDTALDGKYKDEKKELSEAWGNILIASENVLKSTVDGHKSRSEYLANIKEDIKSNEELEKQISSKEIDGFYNLVGHLSNFQLRLLRKYFNDPNMSGVSYWDEKRLEKYFYQWVQGWHTKGGTDEAEKKNIILKTKGAPLLKTLKSLSADLTIPPYEDQNNRRPPKCQSVLLSDEKLTMHYPKWKEWVGQLVKQNDNAYLNENVTLANALHRIVERSRSIDPYQLRLLISITDAEKRNDLAGYKRLKLSLGSEVDEFLLLVKNIVDETKEAREGLWFETENKLFFKCGKTPPRKEKLKSTLLSAVLGKNLSDDEQSSFIEEFWKSGTPKIERRNVRGWCRLASQVQKTYGVYLKEYGLQQLHKLEAGKKLDDKPLALLYKNSGLIASKIGEALNIEPDEVSRFASPHSLAQIFNIIEGDVAGFNKTCRACTYENIWRMQEEKVESLLTNQLLSEIHGERKVPLKSAMCTRLSADSTRPFDGQMASIIEHIARKIAQHKIAQINDVPKEFSIDIPIIIESNQFSFTAELEEIKRGRGSAKAKKAKELGEKSKAGWVSKTERIKTSSEGICPYTGAPLGGSGEIDHIIPRSLTGRTKKTVFNSEANLIYCSSKGNHDKGNRVYVIEQLNDKYLKKQFSTSDVNLIKKKIKTTIQRFTEGGEKLRSFSELSREDQKAFRHALFVPELKSEVTSLLAVKNITRVNGTQAWLAKKIASLLAEHLDKQGRDYTLSAHQIDPWSVSKQRKMLASAEPIWAKKDPQPAASHVVDAVCTFLEALEQPHTASRLKTISSTSFEKTGWRSALIPDLIKVDALDRRPKYRRYNIGSTSLFKDGIYAERFLPILIDENGLMAGYDIDNSLKAKGADVVFESLSPFLLFKGEEVGAQSLSDWQERIDGRYLYMSIDKVKAFDYLQEKVGEKDIAAELLNSIHFTQRKTELRAKFSDDSGKKMKTLDAIRKSLKLTVTVNEIGKRKEKCGFSGTIGIPAKSAWENLLDEPLLETYWGTKMPPQEIWEKVYRKHFPRNIPNQAHRKVRKDFSLPVVDSVSGGFRVKRKTPNGYNYQLLAIDGYSAVGFKKEGDNVDFKSPALVPQIAESKSVTPISSELVHLDKNEIVYFDEWRKIDISDSDLKQFVSSLELAPGSQNRFYIRFTVDEDQFERHFKSALRVNGIQDLDTVNKTFDWNREIPSLLIPPRSNLFLLETGQKITFEYIANGANAEVKKAYSLRRA

SEQ ID NO: 690 - protein, 1378 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHHEDLKHLKQFVKASLPENYREVFADSSKDGYAGYIEGKTSQEAFYKYLLKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIIQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLGNLKSNILEEKKPKYVKDQVENHHLSDDRLFLYYLQNGKDMYTDDELDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNTSAFLESKGYLNIRDDKLMILPKYSLFELENGRRRLLASAGELQKGNELALPTQFMKFLYLASRYNESKGKPEEIEKKQEFVNQHVSYFDDILQLINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 691 - protein, 1371 aa, Streptococcus gallolyticus; identical to SEQ ID NO: 157

SEQ ID NO: 692 - protein, 1108 aa, Pseudomonas lini
MAYRLGIDLGTASIGAVAIRIENNEPHSIDWHAVRIFREPVVNTPKGLQPKKAARRDARQLRKQIERRARRLRRIANLIPLLGLQKAEVKLGRGQDLTTLRAIAARQPVELHEFALVLLRLAKRRGYAGGFRDSKDGVVKRSCDKLGEEMRLLAETQNLQEVTLGEYLLYRQDHGLPVWLKAERPGLEPRYALREMVIAEFEQLWTTQARHHPILASSHLGKPLKQWFNEALFYQRPLKSPAHMVGNCLLEPNLPRAPRAHMAAQHFRINKTLHDMRWGSGRRAERLCKAQLDVLRQILNDPANADGKVSFKHLHQALSETGLSDARSRTLNLERSSRDQLPGNSTIARWRTLGLHDQWQMLAPRDQTSVINLLADLGGPELLNTEDWHQNIHKSSAKAGGTNLYRRFRPEVVDFINALRECKDNNGQPAFNRLTAMKFEGGRSSYSVKALEKLNTWFNDPWWPDEGPGAKRGNEIDEEAALRVCYPHRYSQPQELLQRLEAAPTTGNDVVDGALRELRKIINQCIDALGERPEEIVVEMAREIGKGVVWRKEQENRIRQNELARRKIASELEKHGLSANNTRILRYQLWEEQDLHWCPYCAHPINLEAATSGMTHIEHVLPRSLTQIGRKRSELVLAHAGCNDLKADQTPWQAFGHDAERWSAVERAAARFKELGNKSYAKDRAKALGFYRKAELLLLKDYESEVLSDESIADFADRQLHQTSWIAKAAAQWLRTITPLVSVSRGEFTALLRHQWRLDTVIAEARLDEKLPVLDIDACPVSPEAFQQFRKQWEGHPPDNLTERTERKLEKRLDHRHHGIDALVIALTSRSLYISLARRYVEESERRARGERVRHDWSIEPTMHNLRNQALGMVRTCNLTHKPDRNPAGRLFKDTAYGVHFPEEGDRAQLTLRKPLTSLADEKSAEKTRKNLHSIASSEVRLLVLEAFEARLSAGQNPKQALSEPVPYPAYGTGIWRVRCMQGYADDAVRIVHKSRQGEHEKRLLNDGYACLEITAGENGKHQVRLVTQREAQGRGFMENRQQAKRVFKGDTVINRRDGRKYLVGYFKAEGYIFLIPHTDTRNFDKIKEANSGKKRVSFNHAHQLERI

SEQ ID NO: 693 - protein, 1390 aa, Bifidobacterium merycicum
MSRKNIVEDYAISLDIGNASVGWVAFTPNYRLVRAKGHELIGARLFEPASTAEERRMARTTRRRYSRRRWRLRMLDSMFDQALSEVDPSFLMRRKYSWVHPEDKNNEAHWFGGVLFDSNEQDKRFYEKYPTIYHLRKSLMEDDERHDIREVYLAIHHMMKYRGNFLTEGELAPSSVFDVEDFLKLLTEILQYADEGETDEDLELQADANGLTEALCTTKGSRSIRAKNAISILKEGAALSKRQEAIISAVFAGLEGNKLDLTKVFPNKEYTPEDKKTLALYFNKADYDEKRVAIGDSGLLEDNECDFLDCIRRQYSAIALKQLLGDFTSISESMCARYEQHQRNWDLIKRYCREESNAENINKNYGALVGWEIVGGQRRSIRGAKDYENKRKAANKFFEELIKGSALPDQEKERLLHDIENDELFPVQRDSGNGVIPYQLHLNELKKIIQKQGRYYPFLLETYIKDGKEVNKLEGLLAFRVPYYVGPLVSRDDMQSSDNRENHWMIRRKKGVITPWNFDEMVDKDKSGHEFIKSLVGTDSYLLGETTLPKNSLLYQEFEVLNELNNVRLSIRTGNHWADKRRVRLGHNEKKLLLEELFAKQATVTKKAAENLLRRTYGNTYEISGLADEKKFVSSLSSYGKMCRTLKASYVNSHKDVVEKIIELQTVFEDKKTLKHQLQLLGELAETNCELLSNTHYTGWGKLSRKLLTSKVVVCKIGNDFAPAKHSIIEIMRETDRNFMEIITDKDLGVGEWINQQNVGAEDGNSYQDIIDDLRVSPKVKRGINQAIRVIDDISKAVGKEPSRIFLELAGDVQQSARTVSRKSRLQGLYKSAGLQKEFRDLAESLNECSDNDLRDDRLFLYYTQLGKDMYTGEPLNLDRLSSDYDIDHIIPQAVTQNDSLDNRVLVARVANARKTDSFQYLPEIANRMRNFWQELLDAGLISRVKFDRLNRQNDFSSHEKERFVQRSLVETRQIMKNVATIMRKRYGNSAAVIGLNSELTKEMRQYLGFSHKNRDINDYHHAQDALCLGIAGQFAVNRGFFANGMVSDGAVNSYNLYLQDYLRGYREKMSAGERRRNKAFGFIVGSMNSQDSDKRINPKTGEIAWDDEDKVYLRKVMNYRKMLITQKVGDSFGALYNETRYGTSAKEGVNGIPFDKHKQDTALYGGFSSAKTVYVVLIEAKKKTRLVNITMQEYAELGDHPSDDALRAVLAKKKPEYGKARILLRHIPPMQLIRYGGALVTVKSATELNNAQQLWLPYKEYCLFDDVISSAIDVDEARLCQMLDVILDAIQKYYPKQRFDETGLSAFHNAFNEVSAEDKKRIVGEMVGMLHADAKNANLKALGMSGRWGRMSNQSGYTFADSDEFIFQSPSGLFEKRISVGELKKRRAR

SEQ ID NO: 694 - protein, 1204 aa, Prevotella ruminicola
MERILGIDTGTNSLGWAIVDKDENQYHLVAKGTNIFSEGVKIEKGIESSKAAERTEHRSVRKHYWRRKIRKIRLLTILSDNDLCPRLKHEQLRQWRLKKVYPTDDTFMEWQRTEDKAQVNPYKFRYICLTQKLDLSDITQRFILGRALYHLNQRRGFLSNRKEATKESEGTVKEGISSLSKDMKDSGCEYLGEYFYQLYQQGKKIRNHYTARKEHYLKEFKAICSKQELDDALIEKLEKAIFDQRPLKSQKGQVGTCTFEKGKSRCPSSHPLYEDFRMYSFINNIKVQVDTLYDKGERSLTDEEKQLIIPLFKRKSKRTFPFEDIAKKIAGKNNYCYIKSNEEKAYKFNYQMDTQVSGSPVNAQLEEIFGEDWLSSVCEVYTLANNKSRFQIMNDVWHVLFFYDDEDKLKEFAKDRLQLDDELAEKFSKISIPNDYAALSLKAIRKIMPYLRDYGLIYSEAVFLANLVDVLPQHVWGIKEMREAAIENVIDVMHSYDKNNIDGITLEGCVKTFLKERYQVSDDNLKKLYHPSMLDPYPRQRPNDEGVFQLGSPRISSVKNPMAMHSLFRLRKVVNLMLKKGYITPDTKVHIEFSRDLNDANKRWAIQTWQRENEKERERCRKEIEKYIASPSDTDILKYQLWEEQNHKCLYTGDEIRITDFLGDNPKYDIEHTIPRSAGGDSTKMNLTLCSSRFNRDEKKTKLPAELVNHDEILERISNWKEKYEDIDKQIRKISTKGATSKEDKDSKIRRRHYLILQRDYWRGKYQRFTMTEVPEGFSRRQGTDISVISRYARMYLKSVFKQVYIVKGIATSDFRKMWGIQDEYAKKERVNHVHHCIDAITIACIGKAEYDKLADYRHQYDDYLFQGKTKPTFDKPWPSFVIDIKHIQDELLIAHYAKDNLEKFTKKNLRGKDGRIIRDKFGNKLQMKGDTSRNSLHNDKFYGAINHEGEIKYVYRTNIEALDAKSIGNIVDPTVRSIIESAIAIHGSLKAAINKGIWMNEEKHIPIKKVRVFRNDVKKPIELKDQRDLSDKDYKQHYYVTNDGNYMMLIFSKLNNKGREIRQHVVINSLEATEVIKSHKRSQVGKVVWESYYSKEGFDLIYKLKSGTMILLYENNRDEVWDLDIRNLQKRLYIITKMKYDGRIYMMHHQEAREKKDLEEKSGSFKINEDYRPLIVNSYNQFNALVQDLDFEINDLGEIRRLI

SEQ ID NO: 695 - protein, 1396 aa, Lactobacillus mucosae
MDSSKQGLRRYHLGLDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 696 - protein, 1437 aa, Schleiferia thermophila
MKILGLDLGTNSIGWAIRETDRVCRKEYSNLFKNNLLDLENEIVDYGVIVFKKGVGNGKSGEFSLAAERRKNRSKRRLYNAKRYRKWELLKVLIDNNLCPLTIDELKLWSVGEWVVENGKKRNKGRKYPMSADFLRWLAMDFDKIGTEFTDGEKLKPEFENPYTLRCFLLERKRDDNQKTKYQIGRALYHLAQRRGFKSSRKSGMSTYAENKEIEQKKNLDSSYSISKYAIEKIQSGRFRASGVIQRKYYEEEFLCICKTQGLEEELTKKLFNAVYYVRPLRSQKGLVGKCTLEKNKTRIPISHPVFEEFRALAYINTIQWRVTGSNKPFEPIPIELKKKILEQLFFRKKRNGEIDTRGYFRFDEIIKEFSENFKYEFNYAKYKDNNPELSENKKISDLLKANPNITACPVIAGLMNVFWESWKNKFITDDNKFGIDWSGLKLDYTVKYGRKKGEKRQLDYESIWHLLFDYILTKDDIDKLRIFCNDVLGWNKERIDLFVDIGLSQGYGSLSKNAIKKIIPYLQQGFIYSEAVLFANLEKVLGQEKFVSNKEDILKTIAETIKGVDIYKEKLHIVNSLIQKYFGEVEFKNAKGLDETIIKSAEHEVINKLKEYFGEKNWNIKSETEKKEYYEFVLDKYLTFLDGKQKPEEKASTRLRRNPEIDYYLLPRLDECVKNILSEKFSASDEGLKHLYHPSDIDVYPKAKNKRLGDPVPPSKGWKNPMAMRTMHELKKLINYLLEIGKIDEQTKIVVEMARELNDANLRWAIKTYQKQREEENKEFAKIILGLAQEKYPNLNENDVDNIDKVRLWWEQLPNGEEIYRQVKELKDDVLKYRLWKEQKCQCIYTGKWINITDLFDGTKVQFEHTFPLSDSFDNSLANLTVCDAHYNMNVKQDRIPTQLENYNKDAIGYSAIEPRLKKWFIKRDTLKERIENNKVETKKAIRIGNIERKNYLIRERHLLQFEFDYWDKKLKTFTLKEIPNWWKNSQLIDTQIITKYSSAYLKSLFTKVDVVRARRNSEDIQDGTVNIFKKIYGIKGDEQKDRGRHSHHAIDAAVLTLIPSSTKREEIIKQYFKENKSKNKFHMLPYQNFDTNHILQIEKNIIVNHIVKDKTLVRTKKKVRKRGLVQYTSEGKPMIMQGNSIRGQLHKETFYGAVLVPERNENGYIIKENDKVKLKENEVWIVYRKPIQNVDINEDIIVDELLKKHIQNQINKGVKITAVKDFRGKLIRHLRCRAKAGRGYLTKKKTIELKKNSSNPKKLHKQFVLTQNEENYLYLLYENNVDSKKICREARIVSLFEMQQLLRDGISIKKIWKENELNQLLGLPLRAIIKVGYKVIFYEKNKEELKELKSNELQNRVFIVYKFNEIGSPYIYLQNHIDARIDDEFQKLSHGKDGYTEFDVSKYQYRLKLKARKLNCVFERIDFEIKPDGELIWKF

SEQ ID NO: 697 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 698 - protein, 1391 aa, Lactobacillus jensenii
MKEIKDYIIGLDIGTNSCGYVVTDKQNNILKLKGKTAIGARLFKEGEAAADRRAFRTTRRRLARRRWRLSLLEEIFDEEMNKVDPSFFRRLKESDYSPKDRRKQFNSIVFESSEADKAFYEKYPTIYHLRNALMHDNQKHDLREIFLAVHHIVKYRGNFLREDSVKAFKAAKFTLQGEDGIGPVDKLNDLLKEIYIEAAPELATDNLSKIEDIIKDKKLYKQDKLKQIANLLPKAVDSKDKAKLNKDIAKQVANALMGYMFRLDTLFSFTDVDVKDYKLKFSDANIDESLDALTSLLTDAQIEFVLELQSIYNTIVLNEIVPDGMSLSESMVKKYDDHKKDLKLYKEYIDSLSDQKKAKQLEAAYALYVNYRKADLLAAKKLFEKKKIGDKKFVDVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNFEEMVDTTESANQFIKRMTRKDTYLLAEDVLPKSSLIYQKFMILDELNRIKIDGKKLTSKLKHDIFEKLFKKQKSINLDNLKNYLLAEGNIPGLIEGLSDGINFNNSFSTYIDYRNIFGDEIDNPNKQADFEKMIEWSTVFEDRKIFKRKLKEITWLTPEQIKQVSSKRYSGWGRLSKKLLTQITDENGVNILQRLWNEPETLTEVLANPVIKRKISEANSLFVQINKVENILDDAYTSPQNKKAIRQVIRVVDDIIAAAHGKKPSQIAIEFARSSQNKAKVPDTRKKQLDKIYNKISSEILDSSIKNELKNLKSNKYLSKDKLFLYFKQMGRDAYTGDKLSLDQLQNYDIDHIFPRSFIKDDSLDNRVLTQKPINAKKSDYGIPALEFGNKYVPDLGITVKEMWKLWQENGLISKSKLINLCTNPKKIGSKRASGFINRQLVETSQVIKLVAIILQAEFPDTEIIEVKALQNTTLRESFHLYKNRSVNDYHHAIDAYLTTIVGNYLYQVYPKLRPYFVYGQFKKFNQEKNIDILKRLKNFNFLRQLIFNTDDNIYISGTKEIVFNKKDIIHKLETAYGYKYMNISRECYQETSSLFNQTLYAHNSSVKNSLIPKKKGLPTEIYGGYSGNKDSFFVLVKIVKKRTNLYRIVGIPTRELAKLNSSNNYNQALNKIVESKLCLKETESFKILIKRLLYGTLIVDNGQKFRIGSFKEKHNVQQLVLQLKSMKYIKFYIDGGQNYFTDVERKKLEKQDRDKCLLYVFDDIMNVVNKRFTLFDMSKYEKDGDSLREKFNCLDFNDKVSILSDLLKAFHANSDRTSITKLKITNLGRHQAGKNGITLTTNAQIIYQSPTGLFERRIKIKDL

SEQ ID NO: 699 - protein, 1079 aa, Defluviimonas
MYRFAFDLGTNSLGWAVYRLTNDTRPASIERTGVRIFPNGRDPQSKESNAAGRRMPRGARRRQDRSLGRRKRLLDDLIGFGLLPSDADARSAVFAANPIEARARAAREQVALEQLGRALWHMSKHRGFKSNRRADKDADEKGKIAIASAALLERLRADGHPTYGAFLHARLVRGEGTRIRPAGDGAKLSYEFYPTRALLEAEFDHIWAIQAGFHPSLTEAMHERLRDTIFFQRPLRPVRPGKCTFFPDQDRLPRWHPAAQEFLILSQLNHLRIVDDQGEQPLDITARDLVARTLMAGTKLSWSGLKKTLKLPSQAEFNLEKGGLKELARNDVAARLLGDTKKPGPLATLWPTLDSATQEEILWQISEVADPEELICWLMERLGLSREVAERVEKIPLPDGHLRFCKTATQAIVEKLRCDVIPYDEAVRRAPLLGGAGLDHSDFQAEEGVDTLPPYNRLPVLQRMIGNGTSDPKDTDLLRYGRITNPTVHIALGQFRRVMNALIAEYGKPAQVVIEATRDMAKSAEELNKIEKTIRDNEKRNDRWRAELQKAGLLVEGARIGDRFLRMRLWEEIGRGPADRLCPYTGRPIALHQLHSDEIEIDHILPFEQTFDDSPANKSLCFRDANRRKGKLSPAAAADRQPDFFDLAAIIGRTKHLPANKAWRFLPGAMEKWEETRGFEDRQLNATGYLARVVRAYTEALFPKTDAEGKRRSHVWVLPGRMTAMLRHRWGLNLGDHNRKSRDDHRHHAIDAAVVGVIDRRMVQVLQTHARNLGVERLDRVLPAPPEPFEGFRDAVLAAVEKVNVSHRAQHGSIDPTDPSQTSGRLHEDTVFGLVRDVPENQAERTIGNVVVRKPITGLTEKEIGQVRDVKMRLSLQDATSLARDKSLPEAERKKRLPEALAKWVQETGHRKLRILKPEAGVRPVHDRDGKPYKWLVPGEISWLDILEAPDGTWFQHATDIWAANSGGAEPWNVAHPSARFIMRVHKNDTIQVFDWDDRNKCVVEGSNQIKRIVRLEPSANRMRLVGINDAGKFDERHNEPNDPFRWDLATISKLKLRRARRVRIDELGRVHTIPHGTV

SEQ ID NO: 700 - protein, 1432 aa, Coprobacter fastidiosus
MKKILGLDLGSNSIGWALVNEAENSDEVSSIIKLGVRVNPLTVDEMQNFEKGKSITTNADRTLKRSMRRNLQRYKLRRDALIKLLKKVGFITDGTILSEQGNRTTFETYRLRAKAPDEEISLQELARVLLMINKKRGYKSSRKIKEKEAGTLIDGMEVAKKLYDEDLTPGQLCLQLLESGKKSLPDFYSSDLQEEFDRIWNFQKQFNPKAFCDTAKEEIKGKNKSQTWAILAKYFIWTDEMVVWNEKESKTERVEKECKLVGLKRTVKKEEQRKENYCWRVQALTEQLDLEKVAVVLQEINGQISTSSGYLGAISDRSKVLYFNRQTVGQYQMAELEKNPNTSLRNMVFYRQDYLDEFDKIWEKQAEFHKELTVELKKEIRDIIIFYQRRLKSQKGLIGFCEFENREIMVEKNGKMQAKVVGCKVIPRSHPLFQEFKIWQTLNNVEVFAGEKKCKRKRTDAFPGLFDGTEDTLMVEGWRYLYQEEKEILAKELSVKKSLKKEYILKLLFDNPQDLDMNFEQIEGNDTGNVLFSAYSKMIEKYGYEPLDFGKPTDKIIEQLQVIFADLGWNTDLLFVDLNKEGKDLEKQPYFKLWHLLYSFEGDNTPTGNGKLVEKLMELCHVGKECALELVNISFQNDYGSLSAKAIKKILPYLKEGNRYDVACGYAGYRHSKSSLTKEEIENKVLKDKLDILPKNSLRNPVVEKILNQMVNVINAIIDTYGKPDEIRVELARELKKSAKEREELTKAIAKSTREHEEIRKVLQEEFGMINVSRNDIIRYKLYEELKDNGYKTLYSNQYIPKEKVFSKEIDIEHIIPQARLFDDSLSNKTLEYKAINIEKGNKTAYDFVKEKYGEKGLQQYLNRCESLFKGQRTKLRKLKMGQENIPEGFIDRDLRNTQYIAKKALAMLNEICRRVVATTGSITDRLREDWQLVDVLKELNLPKYETLGLVEVYEDKDGRKIKRIKDWTKRNDHRHHAMDALTVAFTKDVFIQYFNNKNAAWQADCKEHSDIIGIKTRYFENGRSLPPMPLVRFRAEAKSHLETLLVSIKAKNKVVTNNVNCTKRKGGENKKLQQSPRGQLHLETIYGSHRQYVTKEEKVNASFDSSKIATVCKQAYRNALLERLAAFGNDPKKAFTGKNSLEKNPVYLNREQTARVPERVRTVELETVYTIRKPVDPNLSVDKVVDAKVRSILEQRLREYDGEAKRAFVNLDENPIWLNEEKGIAIKRVTIRGINKVQSLHGKKDKNGNLILDETGKKIPVDFVNTGNNHHVAIYRKPVLNKTGQEMLDNEGNPVYELDEVVVSFFEAVTRVNLGLPVIDKNYNKSEGWQFMFTMKQNEYFVFPNEKTRFDPKEVDLLNPENYAVISPNLFRVQKITEKDYMFRHHLETKVVDDKFLKEITWKRILTPNKLEGIVKVRVNHIGQIVSVGEY

SEQ ID NO: 701 - protein, 1131 aa, Acidovorax ebreus
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 702 - protein, 1397 aa, Gemella bergeri
MNENKEWFLGLDIGTASVGWAATDTNYNLLKLKGKKSWGVRLFDEAQTAKERRDCRSKRRRLARRKWRLGLLEELFAEEINKIDPNFFMRLRESKYKVSDKTGNVPSILFNEKNYTDKEYYRNYKTIYHLRADLIHKNNPDIRELFLAIHHILKYRGHFLFAGQQFKGSEIKDNIRELLQYNSLNIKIDITDELINNIAEILLKKKNSTDKIIEFKKLFADEKQLIEALRLALGNKTQLAKLFDIEAYKELDISIKTISFKEKIYEDVRSNYEEILGEYIIVLDTAKLIYDAIILSKIKIKNMTISESKVVSYEKHGKDLKQLKHLIKEDCKLSKKEKRQLFENIFVKEDEKGANYVNYIGKNNAGSSKSSCSYEDFKKFLTKELKCCEESKLKQDILAELELETFLPRQRTKDNSVILYQIHKEELEKILNNAVQYHPFLNNTDEYGISIKEKIIQLLEFRIPYYVGPLNTSHKVGDGGFSWSVRNKGYEHIAVTPWNFNKVINKEESAKNFIENLTNQCTYLLYEDVLPKHSLLYSEFALLNELNSINYGGKRLTVEHRNLIIERFFKQSAPKATGKELKKFLMSEGVIDGKDELSGFDVSIKNDLKSYRDFKKILGDKFDSEKVEKMIRWITLFGESKQLLVDKITKEYGDIYSLEEIKKISGLTYKDWGRLSEKLLTEIVSSQLYDESTGECFNIINAMRNNTLLFMELLGTNYDYFEKINIYNRRLRKEITEITPHILDDLYVSPAVKRSIWQVVRIVEELKKIIGSEPKRIFVETTRSNKEKKGDDGRKDSRKKALLELYKKIKTSDIVELEKALGHTVDFDKKKQDLTDIDNNKLKARKLYLYYTQLGRCLYTGKAIDLNNLLSSNSEYDVDHIYPQSKTKDGSWNNLVLVNKTENSKKSNGLISESIQRKNKHFWRFLKAKNLISEEKYKRLTRTEDFTDDELSGFIARQLIETSQSVKAVSQILQNLNPTTEICFSKAENVHDFRQEFGKIKVGKRRNLTEEQQKEAKEGQLIKVRDLNDLHHAKDAYLNIVVGNVYHIKFTRNPKNFIRKNSKNREYTLNTLFYSDKIERNGEVAWEKGKTEKIVSSVMCNNLINVTRRTSEQKGALYDATIYKANAAKEGSYYPVKTKNKNLKDVTRYGGFTSIKIAYYSIFKYDIRNKDKVKENIKIIPIPIYISQNIKTDLDLINFAEKQIKLKKGENIENLQLIYKKLNIGALVKIDYYPYYVGGKTNDNFYIDGAVQVLLSSDIERYLKEVVKFVNFQRENKEAKVSKEHISSEENIELYNTLLCKMTAKIFTHTKNNKYNDLAQDKAKNTFKNLSLEEQCKVLLEILNLLTNKKTTFDLSLINEKASRVKCGFNLLNQKQFSIIEQSVTGLYEKEIKIIED

SEQ ID NO: 703 - protein, 1401 aa, Olsenella profusa
MEKGKHMNLRNTTDEYNIGLDMGTNSVGWAVTDKVGAIAHFKGMPTLGSRLFDAAQTAAEARAHRGQRRRYVRRRWRLDLLQSLFQDEIDKVDSEFFIRLRQSRLHVEDREDGHADYKWPIFNDSDFTEVDYYKRFPTIYHLRKWLIETDQKADIRLIYLAVHNIVKHRGNFLRENNKNLSSRNADPAEAVGHLRLALNNWCLERGYECAWKSGGNDNAILNVLIDGEKRRSDQVREIAKLTGIDCGDAKQSRQCNEAIAKAIVGLKAEMKNIFGEFPAEKTLIYLSSDDDVEVVRDACPDDSVELFQALCELYAAYILQGLLSYAPGQTISVNMVKKYDRYGEDLHLLKELTRTYASKRYDAFFRGETYEGSSDYVVDKAQGYTRYNLGTTQLSYDDFQKAVKELFKGTDALQDERYQGMMVAFGEQRFLRRLKTSDNGSIYYQLHLEELHAILENQGKHYPFLLAEEDKIESLVSFRIPYYVGPLTRENAAVGHDGKERFAWSSRRDGMEHAVITPWNWEEIIDRDKSAEDFIIRMTGDCTYLQGEPVLPKCSLLYEEFCALNELNGAHWTIDEDDERRFDAAQRERIMCDLFRSTRKVTYKKVSDWLEREDSFVGARVHGGQGEHGFESQLGSYIFFCKDVFKTDSLDEADYPMIEQIILWSTLFEDRDILRRKIEEAYGDRLTTEQIKVICKKRFAGWGRLSKKLLTGIKVDTDTGRKSIIDVLREGNPNDGQRSRTMVFMEVLRDEGLGFQKAVDDFNRDYFSEHNNGLMDVNDLPGSPAIRRSINQAVRIVDEIVSIAKKEPANIFIEVTREEDDPRKKGKRTKRRYDAIKSALEVFKKDDPQLWKELTKKDSNNMDERLSLYFMQRGKCMYSGRPIKIEELHTGKYEVDHIIPRSYIKDDSLENKVLVYREENQHKTDTLLIDSSIRRKMGKYWRMLHNAKLIGDKKFRNLFRDHIDDKTMKGFVARQIVETSQMVKLVQTLLEARYPGARIVPVKANISHDLRDAAGLVKCREANDFHHAHDAFLACRVGLFIQKRHPSVYDNPIGLAHIMRDYARAQAREYKKSHYLAHTKGFIVNSFLSSGFDKETGEVFKDDWDAEAEVEGIRRVLNYRQCFISRMPVEATGTFWDQTIYSPKCGKKLTLPLKRGLDPDRYGSYSREQFAYFFIYEARDLKHERHILQFAQVPVRVAAHIAKDPSQLESYAVKLAGQANLAFVRIVRRRILKKQLLELNGDRLIITGVREVRNATEFAFSLDEETLIERCVQIAKVGSLIGVVNDEDEEQLSADLNELFSSLVKRGPKLCNRLYAQLKLDKYLSKFDELTLTDKAKVVLQLIAITNGSINMADLSALGSSKYAGCMQVSYFKQLNAPIGEVNIIDQSVTGMFERRTHIGL

SEQ ID NO: 704 - protein, 1103 aa, Actinomyces sp. oral taxon 181
MTKINDDLRYRVGIDVGLKSIGFCAVEVDENDQPLRLLNSMVFVHDAGVDPNENKAAKSRKLTAGVARRTQRGTAQNRRRLAELDRALSEELNWPLPNLEDFEDSYEPWHTRAELVEHYIKDDAERAEALAIAIRHIARHRGWRNPYLSVDSLLTPQEPSKFLRGLNERVTQALGREFPADATPGQLICAYIDSPKYAETQGIRGDSGILSGKLHQFDNVGEIRKICEVQRLDHDVFKLLVRKVFFAKSPRGSAAGLVGHDQIPGQGKYIRAEKAHPDFQLFRIVAVLTNLRIREGKAERCLTPDELRGLVDYILEVQLKQQVTWADLADNLGIERTDLRGTARASFDGSPALRFPPTDVTAEKIMASKVKWLKDWWDKADSERRGFMVDALSNSGGSTGDNDIDDEVAALLEAATEDEQAELEKIQLPQGRAAYSLDSLRRLTKRMLEEGVDLHTARKEEFNVDDDWRPEPEPIEAPVGNPAVDRVLKQVARWLNMATDRWGVPDVINIEHTRDGLGSEKVARELLRESQKRQDLNQKDMDKMIRELGISGKARRSSLIKYQAIQRQNSMCLYCGTEIGFETAEMDHIVPRALSGSTNDRSNLAAVCRACNHQKGAVPFAVWATSGEAHAGVSLEDAIKRVRLWQKGPGMSPKQHKAFQNEVISRLKSRKPDEEFDGRSMESVAWMAVELRTRIDGYYRKVNSDSVPKVGIYRGQLTAEARKASGFENRVNLIGGKGKTRFDRRHHAMDALVIAMMNQSVSQTLALRVNMRESQRITGQEETWKNFYGKPGQASERFEKWREGMLRAVELFNIELAKNAIPFHENVRLRVGSSKVHDDTVRKFIHAKLGEALSVAMIDCAETPALWTALTRLPDFDPKDGLPEDLSREIYIHSRKITADEQLNFFNSPSACLKVRGGYVEIGSSIHHARVYRIDGKKTTYSMVRVFATDLVKMTHEDVFTTPLKPSTISMRTADPKIRKALADGTATQIGWLVEGDELQLETDKYSGGLIGEVLAEYPQLTSWRVAGFYGVTQLRLRPYMLAAEGIPSDASESLRKVIEGKGWLPAINALLSSGCVKVVRRNCLGEPRFNAKSSLPVSQLLR

SEQ ID NO: 705 - protein, 1217 aa, Prevotella disiens
MEKQRILGLDPGTNSLGWAVLDFDNSKQEYNLVRKGEVIFEEGVGKSERGEFSKAAYRTFYKSTRKHYFRRRLRKIEVLKVLVKYDFCPYLSDDLLKQWHEKKIYPAVKEFMDWQRTSDAEGKNPYYDRHCCLNEKLDLSLKSDRYILGRALYHLTQRRGFKSNRLIQNNDENEEGKVKKGISELSTEMQEANCNYLGDYFYKLYTEKGNTVQIRKRYTDREKHYKNEFNAICEKQELNETIVKELDKAIFFQRKLKPQRHGVGKCTFEPNNRRCAISHPDFERFRMLCFINNIKIKTPFEENLRPLNNEEKALIEPLFYRKSIKNFDFEEIAKKLAGKNNYCYIKDDSSKQYKFNYRMSQGASTCQTIAKLKSIFGEEWKNGIAETYTNRRKKEGLKKQAEMVDDIWNVLYSVSECDVLKDFAINKLQLDEKTADNFSKTKLAQGFATLSLKAIRKILPFLEQGFGYTEAVFLANIPTVVGKEYWNNEDIRNDIMEEIKTIFYHNTLKTNDSHNTILFCIKDILSNNFDLAPGAIDKLYHPSMINVYKDVIPNEDGILQLGSPKIDAVKNPMAMRSLHIIRKVVNELLREGIINSDTEVRIEYARELNDANKRHAIADWQKKQYGKHQKYRKEIKELFKAETGFEIEPNETDILKFELWEEQNHICLYTGQEIGISEFVGENPKYDIEHTFPRSLGGDSTKMNMTLCENKFNRENKQKKLPSELANHSEILERIDDWKKKIYILQKKYDSIRTHNGMDKENKDKKIVSRHKIKLELDYWKGKYNRFTMTEIPEGFSRRQGMGIGLISRYAGLYLKTIFHKKDNPQKSNVYIVKGSITAEFRRIWNIQDDYEKKCRDNHIHHCIDAIVVGCIGKREYDLMAQFYRDEEKYRWEKKKKPFFKKPWETFTQDMLSLKDEVLTVHFNPSNFTKKAHKKVFTPKGIFVAQGDCARVKLHKGSYFGAIEQKGEIKYVMRKELSALKIEDIKNIVDAVVKEKVLAVVKKKGFKQAMAEPIYMNEDKRILIKKVRLFVSQANPLIVKKHRDLSSKEYKQNYYVDNEGNLMIAMYEGVKKNGKIDREITVVNNLEAAKFFRQSQKNNAEKQLISHLSPKNGYPLKTVLTQKQLVLMYEDSPKEIKLRDTKNMVKRLYQVFGIEKDGRVKLKFHQEARSEGLNINSAAFKIQDTPESLYRHTKSNLKVLVNGVDFKINILGEISLI

SEQ ID NO: 706 - protein, 1391 aa, Lactobacillus kunkeei
MKNYHIGLDIGTSSVGFAARDDDNNLIRVKGKNVIGTRLFSEGQTAQERRMARASRRRYNRRKWRLRLLDEIFHDEIIHKDAEFFNRLKQSSLSPKDERKQYFGSLLFPEVGDSEYYHDGNQTIYHLRHRLMTQDEKADIREIYLALRHIIKYRGNFLDDTPVSSFEASDLKLASFVPTLNDLFETIDVNYEFSMDNINEIEDILLNNKLRNSDKSKQLPDLLTEPIVNIDDKSLEKQFNKERTDISKEIAKSVVGSKMNVNKLLSFESSGGYKIAFSFSDASSEDKMMELSDVLDDSRMNILNILKVIYSRVRLNQIIPSGMGLSESMVAAYDLHKQQLKDLKKLLNVLPFNERYAVKIAYAAYIGNIDKQKFTKSEVKTIDKLKEKSAIMNVLDFKSGHITNEELSNVIKVVIVDKYLNDENFEYHSIVEKINQDISNGSYLLKQRNNQNGNIPHQLHQMELDQIIENQSKYYPFLGELNPNSNRNHIAKYKISELVAFRVPYYVGPLITPEEQEKTSGASFAWMKRKEDGAITPWNFEEKVDKEETASRFIKRLTVKDTYLLNEDVLPDNSLLYEKFKVLNELNVVKANNKRLTVEEKQGAFDNLFKKMKTVTAKKLKNYLVSNHNHINSVEITGLSDVDKFNNSLSTYIDFKKIFDDKIDNPDLLDDFEDIIEWSTVFEDRKIFEEKVRKDISWISESEIKAVVSKRYSGWGRLSKKLLNGITNNEGRNIIDELWEESETFMEAVSKPEVKEQIDGINSDFIKNTDIESVLADAYTSPQNKKAIRETHKLVKDIQKAMGGQAPASISIEFTRNPQDKGQLTRSRHSEVSRKYKEISKEVSKTLNDELKSKKNSMDVDKYYLYFMQMGIDLYDGSSIDIDDLNNYQIDHIIPQSFYKDDSFDNRVLTHYSNNQKKGNNTPLNGLNIDDKTRAIWNHLRDLGLITKKKYNGLTLKGMDQLSKYTKHGFIRRQLVETSQVIKLVANILSDEFSTDDTKIIEVKAKMNSQIRQVFNLYKVRELNDYHHAVDAYLTTFIGGYLYNRYPNLRNMFVYGDFKKFSADVDNLKTFNFLHDITNPSDKFEDRIFDEKSGELILDRKHAIETIKKIYQYKYMLITREVSTKNGQLSDQTVYSAKRINNVKAPIPVKKDSNPELYGFRTGNVDHHMVIVKYPKKDSYDYKVVGIPLRFVQKLKETKDNKDYENLLNQIVQMKLNRKKQDFIVVVDNVMYGQLIQDGGEKYTLGSSTYKYNAKQLVINMDKTRILEDNRYLNSLDEGEVSEKLVNIYNDIMKVVNSRFDLFDINKFREKLNDGLNKFKNISNEQKEETLLKILSGLHCGSANVPIKELGLTTPLGKLQLPSGIVLSEEAVVIYQSPSGLFENKVRLKDL

SEQ ID NO: 707 - protein, 1352 aa, Megasphaera sp. UPII 135-E
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGASIEELVRTLLGKQGLAILDDTIDSNEMVNILKNTGETKSDRKKDVQELWNPLKDKVKKAQAAEMAGLVLGLKSDISKLFANSDYKDLDSSIKNINFSSGDYEEKRDDYANSIGDDIVLLDTMKALYDTLILSQILQGKRSISAAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYNFLNDVSDGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVAIKQLYIEQVFKQEHKKQTKGRVLDFLKRNGLITGSATAVITGMDDAIKGDLQSYRDMVRIFGAGFDHSMAERIIRWVTLFGEAKDILENKIREVYGNSISDSQMRAIKKLKYADWGRLSQAFLIAVKGCDKSGVERNIITCLRASSQNLMEILSDQGTYIKQIKAWNHQHTTNMMDTLDYQLVDDLYVAPSVKRSIWQSLCIVEELVKIMGQAPKKIFVEVTRTKQAEKTKKDSRKKRLVELYTAIGKEGAAWKKEIEAHQAGDFRRKKLYLYYTQMGRCMYSNEPIAMDALFTSAYDIDHIYPQSLTKDGSWDNLVLVKSQLNKEKSDQYPLRPAIREKNKAHWQYLCRAGFISEKKYERLMRTTELTAEELSGFIARQLVETSQATKAVTGLLERIYTNTEICFVKAETVSQFRHQHNFIKIRELNNYHHAKDAYLNIVVGNVYHEKFTKNPWEFIARSTERRPYNLNRMYDFDLLKQGRVIWQVPKSLETVQAMMKSNDVRITKKLLVQKGELYDATITKAHKAKEGTYFPLKGADARLRDVHRYGGYEKIKIAYYSVFSCREKASNTIHTLIIPIPVYKAGLLQTEADLTAYAWQTKQKTKPIKDIYSAITPIYKKLCINTVVKIDGFKYFLGGKTGDYMWLDPAIPVVLDEQAAAYLKAISKVGRADDVENTAQAIDLITAEANEAFYDVLLKKMEAKIFAKAYQTIVEKLASETARERFRELSIGAQCSCLLEILNLLANNKTTFTFFKDKMGVTMSRRKQPMDLTKLEECIVYETSITGLYEKAVSLL

SEQ ID NO: 708 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 709 - protein, 1391 aa, Lactobacillus paragasseri
MTKIKNEYIVGLDVGTNSCGWVAMDFQNTILRMHGKTAIGSHLFDAGNSAADRRAFRTTRRRIKRRKWRLKLLEEIFDPYMTEVDPYFFARLKESGLSPLDKRKNVSSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKKVFKINKVKSIHQLLSLKTENKERTKLIKDVSKQIINAILGYKTKFETILLKNISKDEADDWEFKLTDVDADNKFENLIGDLNENEQEILLEIRNLANAITLSNIVEEGKTLSESMIDKYNKHSDDLELLKQVISDHPDRDKAKKLALAYDLYVNNRHGKLLQAKDVLGSKKTLSKEDFYKEVKKNLDDSKASQEILDTIALDSFMPKQRTNENGVIPYQLHQLELDRIIKNQGKYYPFLKEVNPVSSHLKEAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKEELYNNLFKKNSTVTTNKLKSYLKENYNLINVEIKGLADEKKFNSGLTTYNKLRNLKIFDQQLDDLNYDKDFERIIEWSTIFEDKAIYKDKLKTIKWLSDRQIDKLSKIRMQGWGQLSKKLLSQLTDNNGQTIIEQLWDSQNNFMQIVNQSDFKDAIAVANQNLLVNTSVEDILNEAYTSPANKKAIRQVVKVVDDIVKAASGKVPKQIAIEFTRDADDKAKISQTRANKLRKVYKELSNELASETIRNELERVAKDQKLLKDKYYLYFMQLGRDAYTGEPINIDDLGQYDIDHILPQSFIKDDSLENRVLVKKAVNNGKSDNVPVKLYGNRMAADLGMTIRHMWEKWKDQGLITKTKYNNLIIDPDKINKYESSGFIHRQLVETSQIIKLVSTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKSNDIISLETKKKVFDKKDIIEKLKHAYNYKYMLVSRETETHDQEMFKMTVYPRLSRDTKKSRNLISKKKDMPTEIYGGYTNNSDAYMVIARINKKKGTEYRVFGVPMRELVNLRKAEKNGRYNAYLKQVLEPEIMYSKNGKKNKTISSFEIVKAKVPYKQVILDGDKKFMLASSTYVQNAKQLTLSQNSMQAITDNCENDTEEEKALEEKALIEAYDEILTNIDKYLPLFDINKFREKLHAGREKFINLSLDVKKDTILQVLNGLHDNAVMPKIKSLGLSTPLGFMQFSSGVPLSENAKLIYQSPTGLFEKRVKISDL

SEQ ID NO: 710 - protein, 1117 aa, Actinomyces sp. oral taxon 848
MKQYNAGIDVGINSVGFAAIEVDSKGLPLNILNNMVVLHDSGVDPGTAKTGATRLANSGTARRTRKLIARRRKRLQKLDRYIEVQGWPLVDFSSLPDPYTPWKIRAKLTQDRLEGEEQGRGLSIALRHMARHRGWRNPYEGVESLHSPKEASKQFKDLKDRVTKVSGVIFDEDATPAEVVCDIGLSPKQRLRSAPSAKYKEGATLADEPVGGKSKEGLLGGKLMQSDNANELRKIGIVQGLSNEKVNEIIDQVFASESPKGQAGKRAKKDELPGQEQYVRALRAHLAFQRFRIVAAVANLRILEAEPKHERLLSQSEKDKVIEFLMSADGDDGVTWSDVAEELGIERECLSGTAKRGADGERPSSFPPTNSTNISIVRSKVKPLIEWWRKASDDEQATLVTALSNADELTDDQPSAETVRQFLSSPDEQSQEKIDKISLPKGRAAYSVNSLERLTRRMLKDSVDLFEARKREFGVDNNWTPTPDSIGEPVGNPAVDRVLKIVNRWLLAVTRKWGPPKVVNIEHVRVGFTSAAQTRKYEEENKTNRERNLAILEELRDKFGTSGKIRREDITRFAALRRQNCQCAYCGEAITFFDCEMDHIVPRKGPGSTNTRNNLVAICERCNKSKSNMPFSLWAQNCDIPGVSVEAVIDRVRTWIKDPELNPKQYNNFKKDVIERLRKTVDDDAIDNRSIESVAWMATELADRIGSHFRTAGANTKVRVYRGWLTSEARKASGFEGKINLIGGRGKTRLDRRHHAMDAATIALMRQSVAQTLVERASIRESDRLRRVVSSSWKDYRGADRDKQFSYGSWLNSMNALAELFNRAIDADGIPVTQNLRLRLGNGEAHDATIRSLEKKRVGASWTIGEIDRASTPQLWLALTRQEDFDQNDGLPANASRELRVKNHWFHAEENVTLFPTKSAAIAVRGGYAEIGNTIHHARLYKLPGKKLTYGMIRVFAIDLLCAWHTDLFSSPLLPESISLRTAETKVRRAVEDGAAMYIGWLVDGDEIVLDPETKAFKSNKIGEYLCEFPGTKRWKVDGFPDKEKLRLRPLQLAGEGLPEDVSAGTEEILGPKGNGWRVAINALFKSSQLVVVRRTALGMVRKLSRRHLPLTTRLRG

SEQ ID NO: 711 - protein, 1000 aa, Campylobacter subantarcticus
MKILGFDIGINSIGWAFVENDELKDCGVRIFTKAENPKNKESLALPRRNARSSRRRLKRRKARLIAIKRILAKELKLNFKDYVAADGELPKAYEGSLASVYELRYKALTQKLETKDLARVILHIAKHRGYMNKNEKKSNDAKKGKILSALKNNALKLENYQSVGEYFYKEFFQKYKENTKNFIKIRNTKDNYNNCVLSSDLEKELKFILEKQKEFGYKYSEGFINEILKVAFFQRPLKDFSHLVGACTFFEEENRACKNSYSAWEFVALTKIINEIKSLEKISGEIVSTQTINEVLNLILDKGSITYKKFRSCINLHESISFKSLKYDKENAENAKLIDFRKLVEFKKALGVHSLSRQELDQISTHVTLIKDNVKLKTVLEKYNLSNEQINNLLEIEFNDYINLSFKALGMILPLMREGKRYDEACEITNLKPKTVDEKKDFLPAFCDSIFAHELSNPVVNRAISEYRKVLNALLKKYDKVHKIHLELARDVGLSKKAREKIEKEQKENQAVNAWALKECENIGLKASAKNILKLKLWKEQKEICIYSGNKISIEHLKDEKALEVDHIYPYSRSFDDSFMNKVLVFTKENQEKLNKTPFEAFGKNIEKWSKIQTLAQNLPYKKKNKILDENFKDKQQEDFISRNLNDTRYIATLITKYTKEYLNFLPLNENENTNLKSGEKGSKIHVQTVNGMLTSVLRHTWGFDKKDRNNHLHHALDAIIVAYSTNSIIKAFSDFKKNQELLKARFYAKELTSDNYKHQVKFFEPFKGFREKILSKIDEIFVSKPPRKRARGALHKETFYSEDEMIKKYNSKEGLQIALSCGRVRKIGTKYVENDTMVRVDIFKKQNKFYAIPIYAMDFALGILPNKIVVVGKDKNNNPKQWQTIDESYEFCFSLYKNDLIMLQKKDMQEAEFAYYNGFDISTSSICVEKHDSKFENLTSNQKLLFSNAKEGSVKVENLGIQNLKIFEKYIITPLGDKIKADFQPRENISLKTSKKNGL

SEQ ID NO: 712 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 713 - protein, 1172 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKNCKRKNSKTKNYQRTCGNKNNGTR

SEQ ID NO: 714 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 715 - protein, 1032 aa, uncultured Termite group 1 bacterium
MKKRILGLDIGIASVGWALVEFDDEFQDNKKKGTIIKSGVRIFTRAETPKERESLAKPRREARSQRRRIRRRVERLNSIRELFVKNGVVEEWSVSKKNPNNIYITLNQIKTPWQLRMESLDRKLTNEQFAVVLTHLAKHRGYKSLRKDDKAGKVLEAISQNKKRLNDSDYRTLGEMFCKNESYKEHKRNKGGEYINSVARELIEEEVEKIFVKQREKGNNFADVNTEREYLKIAFSQKPAGSISKMVGFCTFENGEKRAPRDSYSAELFKVLCTINNTTFTDMKTGEIRSFSKEEIGKTLETVKNVKDVKYAKIRKDLGLEDSVKFSGVDYRENAKSKGEGEIFVSMKTYHEIKSKIEKLSKEKWDNLKGNTELLDSIVNIIANLKDDESIKKEFQKLKIDEDIIDVLLNFEFKKFINLSFKALRKIIPFQFQGQKYITASTSAGYSLKQEGIKNKLVPPAKENINVAVVARAFAQTRKVINAVIRKYGQFDQINIELATELKNSKFDRSKIEEGQKKFQSQKDKIFKEVQELRGGMTPSSSLLLKYRLWREQDERCVYSGRKISFEDLLDTGFLDIDHIIPYSKSMDDSFNNKVLCLAEENRNKKNDIPFNYYQRIDRDWNLLISIITSMKNMKIAKKSRLLKQELSDIEGFIERNINDTRYATRYIKDFLENNLEFKENEFIKVKVQARSGGLTSVLSYNWGMSKDREESYFHHAKDAIIVACSTQGMVQYISKISQQYENDKDKMKKIKDKTENCIPKPWDSFRADVEESIEGIFVSFAPRHKVTGSAHKETIYSKKHLEKERYVTVKKSLDKIKLSDLENIPCNENCGIIRVLKERLEKFKNDSLKAFADPVHMPTKCPNKKGPVIRSVKIKESNKTGIEVRKGLAERGEMVRVDVFIKDKKYYLVPIYVSDFKNKDLPNKAIAALKLENEWIMIDKTYSFKFSLFKDDLIKIKKKKEEIFGYFGGVHRSTGTIKIKSRHKPKEIDEGIGSRCLLDFRKFQVDVLGNYTEVKHEKRMPAYITRKDKKH

SEQ ID NO: 716 - protein, 1064 aa, Simonsiella muelleri
MMEKFHYVLGLDLGIASVGWAAIEIDKETETSIGLLDCGVRTFERAEVPKTGDSLAKARREARSTRRLIRRRSHRLLRLKRLLKREIFRQPETFKDLPINAWQLRVKGLDSRLNEYEWAAVLLHLVKHRGYLSQRKSEMSETDSKSEMGRLLAGVAENHQLLQQEQYRTPAELALKKFVKHFRNKGGDYAHTFNRLDLQAELHLLFQKQRELGNPFTSPELERQVDDLLMTQRSALQGDAILKMLGHCGFEPEQFKAAKNTFSAERFIWLTKLNNLRIQDQGKERALTADERTKLLDEPYKKSKLTYAQVRKLLSLPQTAIFKGLRYDLEHDKKAENSTLMEMKSYHNIRQTLEKSGLKTEWQSIATQPEILDAIGTAFSIYKTDEDISHELKTCRLPENVLNELLKNINFDGFIQLSLTALRKILPLMEQGYRYDEACTQIYGNHHSGSLQQESKQFLPHIPIDDVRNPVVFRTLTQARKVVNAIIRRYGSPARVHIEMARELGKSKSDRDRIEKQQQKNKKERENAVAKFKEDFPDFVGEPRGKDILKMRLYEQQHGKCLYSGHDIDINRLNEKGYVEIDHALPFSRTWDDSQNNKVLVLGSENQNKRNQTPDEYLDGANNSQRWLEFQARVQTCHFSYGKKQRIQLAKLDDETEKGFLERNLNDTRYIARFMCQFVQENLYLTGKGKRLVFASNGGMTATLRNLWGLRKVREDNDRHHALDAIVVACSTASMQQKITKAFQRHESIEYVDTETGEVKFRIPQPWDFFRQEVMIRVFSDQPCEDLVEKLSARPEALHDNVTPLFVSRAPNRKMSGQGHLETIKSAKRLSEENSMVKKPLTTLKLKDIPEIVGYPSREPQLYAALKTRLETHDDDPIKAFAKPFYKPNKNGELGALVRSVRVKGVQNTGVMVHDGKGIADNATMVRVDVYTKAGKNYLVPVYVWQVAQGILPNRAVTSGKSEADWDLIDESFEFKFSLSRGDLVEMISNKGRIFGYYNGLDRANGSIGIREHDLEKSKGKDGVHRVGVKTATAFNKYHVDPLGKEIHRCSSEPRPTLKIKSKK

SEQ ID NO: 717 - protein, 1371 aa, Gordonibacter pamelaeae
MNLRNVESYQVGLDIGTGSVGWAVLDDNGDLCRFKGKPTWGSRVFPTAETAAEARVHRGQRRRYDRRRQRIDLLQRFFADEVAKVDPEFFIRLNQARLHPENRDPAHADYRWPLFNGSNFTEKDYYRQFPTIYHLRAHLLKSDEPADIRLVYLALHNIVKHRGNFLHQDNPSLSARNANVGDAVEALCLALDEWCGAHDVECACDEAALAEALGDASLRPGEKRERAEAALGVEKAHKKLAKAVSSAVVGYAAEFGHVFFAESEGSKFALSNDEKVEAYVCPDEGRDLFDAMRAVHSSYVLMGILSEAQGELLSVCKVGEYERYKRDLETLKSLVRAYGPERYDEFFCGPFYEGTRDYDPGKAQGYTKYNLGASKLSHEDFLKEVQKLLKDIGAQADERYADIERAIEAGAFLRRLKTSDNGTIPYQLHLEEMDAIIERQAAFYPFLAQEKDKLKSLVSFRIPYYVGPLTQKNAARDGKGEARFAWSSRKPGMEDARVYPWNWEDVIDKDQSAEDFIRRMTGTCTYLKGEPVLARCSLDYELFCVLNELAGARWTQDGDKSYRFDAADRLGIVEDLFKKRKRVTYEAAEKWLARTHGPESGKSAGGAYHVSGGQGEDAFESQLSSHYDFCKILGVDELSDADEAMAEDIILWNTVFEDRSILKRKIKLAYGDRLGDAQVRKLCQKRYTGWGRLSGELLRGLRSATDNGPKTIMDILLEGDPNHARRMGAAMNLMEILHDDLLEFQAKIDEHNRERALAVGGMSVDEVTGSPALRRGINQALRVVDEIAGIAGKPPAHIYVEVTRDEGARNKGRRTTSRYRALEAALSSIKAQCADVYAELKERDPRALDDERLTLYFMQCGKCMYSGDALDINKLQTYQVDHILPQSYVKDDSFENKVLVRPDTNQRKGDTLLLDERLIARMRGFWRTLRDAELIGEKKFNNLTRTSVSDEQMKKFVSRQLVETGQMVKQVQQLLQARYPESEVQPVKAGVSHQLRVGCALAKSREINDFHHAHDAYLACQVGRFVQYRHSAVYSEPVKMAAVVKQFIKKQAEDYRRTRELPGSDGFIVSSFMTPGFDVKTGEVFRDAWDAGAEIDRIRRCFDYKDCFISRMPEETHGAFWDATIYSPRAAGKTLSLPLKRGLDPRKYGSYSREQFAYFFVYEAVKPKKKQRVLEFAPVPVRVASALANDPDALEDYARELAEAEGLVFERIRRRKVYKYQQIIVGDSRLYVTGREEVRNARQLAFSQDETKLICRIEQGEECEEGELLDLFRSMQRKYLACAPRLARLMKVAEMEEGFIAATASGKREVLLSLTSIAAAHRNSIDLKPIGRKGSSGQMKITFSKELSTNGILFVDSSVTGMFERRCRLGL

SEQ ID NO: 718 - protein, 1269 aa, Mycoplasma synoviae
MENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 719 - protein, 1110 aa, Helicobacter apodemus
MRILGFDIGITSIGWAYVEGEELKDCGVRIFTKAENPQNGDSLAAPRREARGVRRRLARRKVRLNVIKRLLCKEFGLNLSDYFANDGELPKAYETTKDTKSPYELRSLALEQKLEPKELARVILHIAKHRGYGNKHAKRDLEAEEKAKKAAEKAPQEKESTTTNGDSKKEQEKVLKALYQNETLLKKYQTNYQTNNKTNDETNNKTIFLVGKYLYKEFQDKGQRIRNTTNNYQHTMRQEWLKDELEFIFKKQKDFGATFSENFESQILETAFYQRDLKSFEDKVGKCVFYENENRAPKDSLSAMEFVALTRIINTLKNLEKKSKNLGIGETYGKDKIQEILKIVLDKGEMSYKELRKILKLNESILFAKDSKLDYTKGMQEAEKAKFIELKNLKAFKKAMGGDFSKFPREELDKIATDIVLIKSKENLAKKLQNYSALSKEQVEALSNLNFAKHIDLSLKALDKILPFMREGLSYDEVVKKVGLQEHRKYKQKGEFLIPLKEYEPYLANPVVARALSEYRKVLNALLRKYGNVHKIHLEFTREAGKNYDERKKIEKEQREHFEANQKAIKQREILGLPINGANILKMKLWIEQGECCVYSGEKITSKHFFDSNALQVDHIYPYSRSFDDSYMNKVLVFAKENQNKLNKTPFEAFGSDKEKWDRILSLSAKLPKQKQRRISNKDFKDKELGFIARNINDTGYIARLASQWTNNCLKFEDLRENEVTIAGEKGSKNHLEVISGQLTSMLRHYWGLGDKDRNNHLHHAVDAVIIAYTNAKTIKAFADFKKNQEQNRAKFYAKQISEQEYKRQRNPFEPCANFRQRVEEKINKIFVSKPPRKRARGALHKETFGSICLDGNNNWVARFKIKSKKEQEDITKEKATKAKYKDEFKGEENIRKALKLGKIRRINNTQKDIAIGDKIVKNETMVRVDIFKDKKGKFYAVPIYTMDFALGILPNKAVATGEDEDGVIKDWIEMDKTKYEFCFSLFKDDLIKVRKKKMKEAELCYFVGFDTDGSRIIVAKHNNDYQTMTENECKLFTLKEKKKKQKTLNDEEDNQERIETEYKIIGGRTGIQNLETFEKHQVSPLGEVQKAEFEDRQEIKLKSSPKGKD

SEQ ID NO: 720 - protein, 1339 aa, Staphylococcus pseudintermedius
MEVSVMGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 721 - protein, 1428 aa, Parasutterella excrementihominis
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRRGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVRSICNAIENERKTYGPYFSEDYKFVKTALKEGKTEKELSKKFAAVIKVLKMVSEVVPFIGKELRLSDEAQSKFDNLYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGTSDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 722 - protein, 1396 aa, Streptococcus anginosus
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 723 - protein, 1344 aa, Staphylococcus simulans
MKKTNPYILSLDIGTASIGYACMDLDFNILKYHDKDAIGVLTFEGADTAAERRGFRTSRRRKNRRIKRLGLLQEVLAPLVKNPNYYQLLNLHKWKNSNEDFKHRSLSEVLKILGKNPKTYPTIYHLQQDIQNHPEKKFEPELIFLALYHLVKYRGHFLFNNLSFDKGKTVDNEAQLSELLEQYQSINPYEDSISNKDINVIVDTLKDDQLTRNDKSKELKRNVSKTHAELFKMLVGLKFKQSILFENMENAEDIKESATGSDAISLSDDYYENLSEFLTDEQLNFIESANTFFMGIMLDRILKGATSISAAKVRDYKIFKNQLKIIKDIVYQNKYDKYHEFFVTSKEDMRAYQENPDAKTFGKLSKFDQYLIHPKDQYAKLMKDLKGIVPKKYTEVLNLIDEQKFLVVQNTTDNASIPYQNNVFEAENILRNQQKYYPEITEEMIGKVINLISFRIPYYVGPLTNKNGQSDFAWMIRKSDEQTLPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAIFGSVENKRQMIEELVLWITIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISDLFGAPEKIIIEFATEDQVKGKRQKSRSELWDDLVKKNNLKRNKKFKGLFEELKAYPDLDFSNPKLWLYIHQNGKCMYTKKPIDLERLMSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEHGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKAQYLFSINKGDALLVNGHPFLFVSAKERINGKQLEFDINMQRRLKKALRPYNKMTEQEKVGVYNQFAEKVVQEYENSLGAKTRNEKLELIRNQFNESDKSNEALIQCILEVLKMTKVSAERSVKLKIRWGSQTPNTLIDINNKAKIMYNSITGLKQTRLKSIYKLAESKNEL

SEQ ID NO: 724 - protein, 1391 aa, Lactobacillus
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKMKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKVIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLTAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 725 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 726 - protein, 1140 aa, Streptococcus parasanguinis
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 727 - protein, 1334 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEVPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSKVVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIEDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 728 - protein, 1504 aa, Bacteroides coprosuis
MKKVLGLDIGTNSVGWAVVNQNDKGEFLSIEKIGSRIIPMSQDVMDKFGAGQTESSTAQRTQYRGVRRLRERSLLRRERLHRVLHILHFLPQHYDAAIGWNKKENKTYGKFLPGVEVNIPWVATDQGHQFIFMDSYAEMLKDLKQHQPHLFEKSSTPVPLDWTIYYLRKKALTQAISKEELAWILLNFNQKRGYYQLRGEEVEDNTKREEFYALKVVKVELDKDNTSAKTWYKVHLENGFIYPCPSDTPIDSWVGMVKDFIVTTTLEKDGSEKRTADGEIKRSFRAPKEDDWTLLKKKTESELEKSGKQVGAFIYDTLLSNPDQKIIGGLIKTIERKYYKKELEQILETQQKFIAELSDKKLFQACAEELYPLNDSHRENLLERDFKHLFVQDIIFYHRPLKTKKSLISNCTYEYRTFYKNGEKQISPIKCIAKSNPLFQEFRVWQFVQNLRILQRQRSEGDSIKYNVDVTAEFLKDENDIANLFTWLNERKVIKQDQLLKSYFKLKVNKETKELDYRWNYVDDKNKEYPCNATRTHILSFLEKCKEEKRIEDDRFVYSLWHLLYSVVEPIELRGALAKFAEREHLHPSFVDVFAQFPPLEKEYGSYSEKAIKRLLPLMRMGDYWHEDKIDVKTKQRIQRIIDGEADDDITHRSREKVENLRSITDFKGLPLWKAGYVVYNRHSESGELTKWKTPHELSNYIQNEFKQYSLRNPIVEQIVLETLRVVHDLWVKHGDFSEIHLELGRDIKNSSDKRKRMAERQQENENSRQRVLEMLIDLKKEAAFADLNPYSPSQQEKLRIVEDGVLRSNIEIPKDIEKITKSAKPTSRELTKYRLWLDQKYRSPYTGQPISLAQLFTSKYEIEHVIPQAKYFDDSFTNKVICESEVNKEKGSMLAHEFILKNGGSTVNVGGRQVQVLKNDAYVELINRLYGKNNPVKAKKLLAEDIDEVVGDFSERQLNDTRYISRVVQKLLSNIVREEDEQESTSKHVIGCSGQVTTALKKDWGLNDIWNKIIQPRFERLNEMTATEDYGVWQSPNHFQIRVPEEIQKGFTKKRIDHRHHAMDALVIACATRSHINYISNRSGQDRNAKFETTRTDLRSKLCYKENSSGNNYNYIFNKPWDTFTQDAHRALENIVVSHKQNLRVLTKTNNYTQFINKDGKKDLQKQVKGDHFAVRKPMHQETIYGRVSIRSIKEVALKKALENWKQIVDRTLKDKIRELIGAYGKYDAQTILKYFKDRDYKFNNLKINRVEVYEYDHNCAAVRKSIGDDLTIKQIERITDESIRKILMNHLSNYDDNLKEAFSPEGLMEMNKNIKELNGGKNHQPIYKVRLFEDLGSKFPLGVSHNNPDKYAIAAKGTNLFFGIYEDQEGKRMFDSIPLNIVIDRLKEKKSPVPETYNESKLKFHLSPNDLVYVPTDEEQKQPELVDVDHLSDEQKGRVYKAVSFTGNRAFFVNHRVSKVIHDYVEFGTKNKIENDDDKRSLKHICWKLKVNRLGEITDVKR

SEQ ID NO: 729 - protein, 1054 aa, Actinobacillus suis
MKLTPLNYILGLDLGIASVGWAVVEIDEQENPLGLIDVGVRTFDRAEVPKTGESLALARRLARSARRLVKRRADRIKKAKRLLKAENILLSADEHLPNDVWQLRVKGLDQKLERQEWAAVLLHLLKHRGYLSQRKNESKSENKELGALLSGVETNHQILQSAEYRTPAEIAVKKFHVEDGHIRNQRGAYTHTFSRLDLLAEMELLFQRQTDLGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKQRESAVKKFKEYFPNFVGEPKGKDILKMRLYELQQAKCLYSGKSLELHRLLEKGYVEVDHALPFSRTWDDSFNNKVLVLANENQNKGNLTPYEWLDGKNNSEHWQNFVARVQTSGFSHTKKQRILSHKLDEKGFIERNLNDTRYVARFLCNFIADNMLLTGKGKRKVFASNGQITALLRGRWGLQKVRDDNDRHHALDAVVVACSTVVMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLSDLERMVNREREVTLYESLKARLEQFGNDPAKAFAEPFHKKGGAVVKAVRVEQTQKSGVLVRDGNGVADNASMVRVDVFTKGGKYFLVPIYTWQVAKGILPNKAVTANVDEIDWLEMDESYQFIFTMYPNDLVKVKLKKEEFFGYYGGLDRATGAIVIKEHDLEKSKGKQGIYRIGVKLALSFEKYQVDELGKNIRPCRPTKRQHVR

SEQ ID NO: 730 - protein, 1110 aa, Candidatus Micropelagos thuwalensis
MSEKYRLGLDVGTNSLGWAVIGLKEDVPSSVLATGVRIFSEGRDAKTKSTLKASRTEKRSARRRRDRFLQRQTFLISEMVKSGLFPKDIVEQKNLELLDPYEIRFKALTEQVPLHHLGRALFHINQRRGFKSSRKDKSEETTSGVVSKSVRALYEEMQLINPAPVIDDPKALSKEERREIRVQEASSREEALVTLAEQKGVTFGAFLYRRLQSGKSVRARKDADSQLYDVYPTRELLKDEYSKLMQHQAQYYPNVINEALISRLHDVIFFQRKLKEQERGFCTYYPSERRTFRCMPSFQQYRMVQELNALEWVDAAGKHCLRDYPESRDLILSELENISTKAGEFTFGNMKKILKKMGVIDGEVSFNFEGPKRKGFQGNVTSREMRHEDCFGTRWDELSLDEKDDIIDKINDDHLDDEDMERYLIDTYGLSSFSVGNAINARLLEGTANVSRKAARTLYETMLSANCLQSDAVIAVSEQDDTFVNPYSRTGRGELLSELPYYGEAFQDGRHIIPGKREPKVSHDQLKFYGGVSNPTVHIALNQIRLVVNEIIKRYGLPSSISIELARNLPEGQDGRRKIEKMQSENQKNNERYDQILTENGQSPNRDNRLRLALWEELGEGPTDRLCVFTGKLIELADLFNGSVEIEHLIPFSVSLDDSKANKTVCWKEANRFKGNKTPYEAFANNSGDYSWEEIMERVRALPNSKQWRFQEDALKIWNSDHSDFSGRHLNDTRYISRLAREYLENICPFNKIDVVTGRLTALLRGHWGLNNILRGHNEPETATPKKMRDDHRHHAIDAVVIAMTSLTILQKVSSAAGKAEELDVGKLFAKDESGRSVIDPWDGFRDEVAEKVRNIIVSHKTKRKTIGNSGKSTDRALHNETAYGLIDGPDEKGLYSVVTTKPISYFDNRDKIEKIRDEKLRDDFLTAWDGEGDNKASQLAVLDKASGLNVKKCRYVERKKVIPINGPDGQPYKAYDGNSNWGMEIYEFPNGHPKEKKWNGVVISTYDANKSEFKPGETFRPHPAAKLVMRLHINDIVEVQNDGEPILYRVQLISAGTLTVSPLHEANVDSRNRDKHDEFKYKSLSVTPMQKMGAKKVNISPTGLKNYSR

SEQ ID NO: 731 - protein, 1415 aa, Streptococcus oralis subsp. tigurinus AZ_3a
MAKFNKPYSIGLDIGVSSVGYAVITEDYRVPAFRFKVLGNTEKEKIKKNLIGSTTFVPAQSAQVTRVFRVNRRRIDRRNHRIAYLRDIFQKEIEKVDKNFYRRLDESFRVLGDKSEDLQIKQPFFGDKELETAYHKKYPTIYHLRKHLADADKNSPVADIREVYMALSHILKYRGHFLTLDKINPNNINMQNSWINFIESCQEVFDLEVSEESKTIAAIFKSSENRQEKVKQILSYFQQELLKKDKSIFKQLLQLLFGLKTKFKDCFELEEEPDLNFSKENYDENLENLLGTLEEDFSDVFAKLKILRDTILLSDMLTYTGATHARFSATMVERYEEHRKDLQRFKSFVKQNLSEQDYLDIFGRKTPNGFDVDKETKGYVGYISNKMVLTNKQKTIQQNFYDYISGKITGIEGAEYFLNKISDGTFLRKLRTTDNGAIPNQIHAYELEKIIERQGRDYPFLLENKDKLLSILTFKIPYYVGPLAKGNNSRFAWIKRATSQDILDDNDEDTRNGKIRPWNYHKLINMDKTRDAFITNLIGNDIILLNEKVLPKRSLIYEEVMLQNELTRVKYKDKYGKTHFFDSELRQEIINNLFKTNSKRVSSAMLLNYLENYTNLQAVEIVSGIEKGKSLNSTLKTYNDLKTIFSEELLDSEIYQKELEEIVKVITVFDDKKSIKNYLTKYFGRLEFLNEERINQLSKLRYTGWGRYSAKLLLDIRDEDTGFNLMQFLRNDDENRNLSQLISDSTLSFDSAIKSIQSKSTVEDDVFDEIKKLAGSPAIKRGILNSIKIVDELVQIIGYPPQNIVIEMARENMTTEEGQKKAKTRKTKLESALKNIENSVLENGKVPHSDEQLQSEKLYLYYLQNGKDMYSLDKTGSPTPLYRDRLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFLDTKIITLKSQLITNFRNTFHIAKIRELNDYHHAHDAYLAVVIGQTLLKAYPKLAPELIYGHHAHFNRHEENKATIRKHLYSNIMRFFNNPNSKVSKDIWNCNRDLPIIKDIIYNSQVNFVKRTMIKKGAFYKQNIIPNDSSVTVDKRFPIKNKKYLDPKLYGGYYERNSALSVFIIGQSFNKNNKLKVVKEFYDINIIDYPLFNTDPMSFFNDDSENGFLTKNNLQSVQAFYKIPKYSLIQKNDGTRMLFESTTNFHKATQFKLTEAQNELFFHMKRLLTKTDFMDLKSEESIKESQDFIMNHKNEFDNIVNGLFGYAERQLGSKSLFTQAHEAYKLRKYPVFSLNEETIRYYYDNFLRLFSLTKSGTSSGYVVGLFEAPKLRNVVYRATKDESNATLIHQSITGLYETRIDLSKLGED

SEQ ID NO: 732 - protein, 851 aa, Streptococcus sp. HSISB1
MTNGKILGLDIGVASVGVGIIEAKTGKVIHANSRLFSAANAENNAERRGFRGARRLTRRKKHRVKRVRDLFEKYDILTDFRNLNLNPYELRVKGLTEQLTNEELFAALRTIAKRRGISYLDDAEDDSTGSSDYAKSIDENRRLLKSMTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVNFAKNSKTLGASKLLKEIAKLVDGDVKDISGYREDSKGKPDLHTFEPYRKLKFNLTTVDIDNLSRDILDKLADILTLNTEREGIEDAINQNLPEQFTKEQISEIVQIRKSQSSAFNKGWHSFSAKLMNELIPELYATSEEQMTILTRLEKFKATKKSSKNTKTIDEKEITDEIYNPVVAKSVRQTIKIINAAVKKYGDFDKIVIEMPRDKNADDEKKFIDKKNKENKKEKDDSLKRAAYLYNGTDKLPDDVFHGNKQLATKIRLWYQQGERCLYSGKPILIQDLVHNSNNFEIDHILPLSLSFDDSLANKVLVYAWANQEKEQKTPYQVIDSMDAAWSFREMKDYVLKQKGIGKKKREYLLTTENIDKIEVKKKFIERNLVDTRYASRVVLNSLQTALKELGKDTKVSVVRGQFTSQLRRKWKIDKSRETYHHHAVDALIIAASSQLKLWQKHENLMFENYGENQVVNKETGEILSISDDEYKESVFQPPYQGFVNTISSKAFEDEILFSYQVDSKFNRKVSDATIYSTRKAKLGKDKKEETYVLGK

SEQ ID NO: 733 - protein, 1388 aa, Zunongwangia profunda
MKRILGLDLGTNSIGWALVNEAENEKEISKIIKLGVRVNPLTIDEKTNFEKGRPLSTNADRTLKRGARRNLQRYKLRRENLIEILIDNHIITKETPLTEIGKGTTYQTLSLRAKAVRERIDLEDFAKVLLAINKKRGYKSSRKASNDEEGQAIDGMAIAKELYERGITPGQYVLELLENDRKYIPDFYRSDLKQEFNKIWNNQKTFYPEILTDELFKELDGKNKSQTWAICQKPFNIKGIKRITKGREKTIENYHWRVKGLSGKLNLEKLAIILQEINNDINQSSGYLGGISDKSKKLYLNKETVGEFLYKQIAKNPHTSLKNQVFYRHDYLDEFEQIWKTQSNFNANLTDELKQEIRDVIIFYQRKIKSQKSLISFCQFESWEQEYFDKETGKTKTRTVGRRVIPKSSPLFQEFKIWQNLNHLVFTNSETDEKIEIKEVEQEIRKELFEELNLRGDLNPNDLLKILRSQFKIGKLSNWKCNFEKIEGNRTNAALFNIYQKISDFEGYGIDWNKSNAKKIRKELKATFPEIGIDASILEFDAYKKQLTNQSSYELWHLLYSAEEDFKISEQDKLIYGNSSVSLKKKLHLKFGFNPEYAKMLANLSLMSDYGNLSAKAIKKILPYLEDGHLYSEACRLAGYNHSKSLTAEELEKFEPKAKLDLLKKNSLRNPVVEKILNQMVNVVNQVIDTYGKPDGVRIELARELKKSAKERAEMTKGIADGTRRNEEIKKIITQKFGIPNPTKSDLVRYRLWQELESRGYKDIFTDKYISPDKIFSSEIDIEHIIPKALLFDDSFSNKTLSFRNVNLKKANRTALDFITQDYQSNVEAYKERVETWNKDNHISKGKRNKLLMSLKDIPDGFIERDLRNSQYIARKAKRMLYEVFPNEVLATSGSITDKLRSDWDLINVMKELNLPKYKALGLTEYEERLDKGTEELFKHEVIKDWTKRNDHRHHAMDALAVAFTTHNHIQYINNLNARKDITQDNHPIIKNIENLITEVNSKGKRVFKAPMSSFRESAKEQIEAILVSFKNKNKVVTKNINQTKKEGGFNYQNAKTPRGQLHKETIYGKSKQPLEKPVKINNRFCKKQVGLIINFKEQEAVLHHLKKYDNNEKIAFSNKTLKSDPIQVNGSPLREVKIFEEIFTIRKDINPDNFKTQKHLDKIIDKGIKEVMKKRLEEYNGDFKTAFSDLDKNPIWLNQSKGITIKRATISGVTNAEPLHQAKDHLGNIILDDNGKEIPIDYVSTGNNHHVAIYQDESGNLQEEVVSFYEAVIRKNQDQPIIKKRHPKGWKFLFTMKQNEMFVFSSENFNPSEIDLLDEKNAAIISPNLFRVQKIATKNYMFRHHLETEVTNNLDFTYRHFQATEWLRNLCKVRIDHIGRIVQIGEY

SEQ ID NO: 734 - protein, 1509 aa, Psychroflexus torquis
MKRILGLDLGTNSIGWSLIEHDFKNKQGQIEGLGVRIIPMSQEILGKFDAGQSISQTADRTKYRGVRRLYQRDNLRRERLHRVLKILDFLPKHYSESIDFQDKVGQFKPKQEVKLNYRKNEKNKHEFVFMNSFIEMVSEFKNAQPELFYNKGNGEETKIPYDWTLYYLRKKALTQQITKEELAWLILNFNQKRGYYQLRGEDIDEDKNKKYMQLKVNNLIDSGAKVKGKVLYNVIFDNGWKYEKQIVNKDEWEGRTKEFIITTKTLKNGNIKRTYKAVDSEIDWAAIKAKTEQDINKANKTVGEYIYESLLDNPSQKIRGKLVKTIERKFYKEEFEKLLSKQIELQPELFNESLYKACIKELYPRNENHQSNNKKQGFEYLFTEDIIFYQRPLKSQKSNISGCQFEHKIYKQKNKKTGKLELIKEPIKTISRSHPLFQEFRIWQWLQNLKIYNKEKIENGKLEDVTTQLLPNNEAYVTLFDFLNTKKELEQKQFIEYFVKKKLIDKKEKEHFRWNFVEDKKYPFSETRAQFLSRLAKVKGIKNTEDFLNKNTQVGSKENSPFIKRIEQLWHIIYSVSDLKEYEKALEKFAEKHNLEKDSFLKNFKKFPPFVSDYASYSKKAISKLLPIMRMGKYWSESAVPTQVKERSLSIMERVKVLPLKEGYSDKDLADLLSRVSDDDIPKQLIKSFISFKDKNPLKGLNTYQANYLVYGRHSETGDIQHWKTPEDIDRYLNNFKQHSLRNPIVEQVVMETLRVVRDIWEHYGNNEKDFFKEIHVELGREMKSPAGKREKLSQRNTENENTNHRIREVLKELMNDASVEGGVRDYSPSQQEILKLYEEGIYQNPNTNYLKVDEDEILKIRKKNNPTQKEIQRYKLWLEQGYISPYTGKIIPLTKLFTHEYQIEHIIPQSRYYDNSLGNKIICESEVNEDKDNKTAYEYLKVEKGSIVFGHKLLNLDEYEAHVNKYFKKNKTKLKNLLSEDIPEGFINRQLNDSRYISKLVKGLLSNIVRENGEQEATSKNLIPVTGVVTSKLKQDWGLNDKWNEIIAPRFKRLNKLTNSNDFGFWDNDINAFRIQVPDSLIKGFSKKRIDHRHHALDALVVACTSRNHTHYLSALNAENKNYSLRDKLVIKNENGDYTKTFQIPWQGFTIEAKNNLEKTVVSFKKNLRVINKTNNKFWSYKDENGNLNLGKDGKPKKKLRKQTKGYNWAIRKPLHKETVSGIYNINAPKNKIATSVRTLLTEIKNEKHLAKITDLRIRETILPNHLKHYLNNKGEANFSEAFSQGGIEDLNKKITTLNEGKKHQPIYRVKIFEVGSKFSISEDENSAKSKKYVEAAKGTNLFFAIYLDEENKKRNYETIPLNEVITHQKQVAGFPKSERLSVQPDSQKGTFLFTLSPNDLVYVPNNEELENRDLFNLGNLNVEQISRIYKFTDSSDKTCNFIPFQVSKLIFNLKKKEQKKLDVDFIIQNEFGLGSPQSKNQKSIDDVMIKEKCIKLKIDRLGNISKA

SEQ ID NO: 735 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 736 - protein, 1512 aa, Fibrobacter succinogenes
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 737 - protein, 1362 aa, Lactobacillus farciminis
MKLGDIMTKKEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTLDKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNYSVLDLMWTTNNNFISIISNDKYDFKNYIENHNLNKNEDQNISNLVNDIHVSPALKRGITQSIKIVQEIVKFMGHAPKYIFIEVTRETKKSEITTSRGKRIQRLQSKLLNKANGFKPQLRKYLVPNEKIQEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALSDQDDRYHFKHPELVKNRNINDFHHAQDAYLASFLGTYRLRRFPTDEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREIANRQQLILPPEHSALLRILQIPDEDPDQILAFYDKNILVEILQELITKMKKFYPFYKNEQEFLASNIENFNQATTSEKINSLEELITLLHANSTSAHLIFNNIEKKAFGRKTHGLTLNDTDFIYQSVTGLYETRIHIE

SEQ ID NO: 738 - protein, 1216 aa, Prevotella stercorea
MTKILGIDTGTNSLGWAIVDKTADNYNLLDKGVNIFQEGVKIEKGIESSKAAERTEHRATRVRYYRIKLRKIRLLRILSDNHLCPPLSQEELSTWRLKKVYPKNELFMQWQRTDDDTEKTPYAYRHKCIHEKLDLSDVTDRYILGRAFYHIIQRRGFLSNRKEQGGEDSGKVKEGISTLTHEMNEAGYEYLGDYFYALYNKGEKIRKHYTARNEHFLSEFKAICEKQDLEKELGSEVVRNIEKAIFDQRPLKSQKGQVGKCVFEKNKTKCPSSHPMYEEFRMLTFINNIKIKTPNDDVLRPLNTGEREKIMPLFFRKSKKQFDFEDITKKLAPKKMYGFYKKEEDAEMPFLFNYPMDTSVSGCPVTAALKDVFGDDWITAICETYTLGEGKSRFDIVNDIWHALYFYSDKDKLAEFAINRLQLSEDEAKIFSEISLPADYASLSLKAICKILPYLRRGLIYSHAVFLGNLCEVMPKYEWSIKEMRETIIDNIIMEMDKCDTKDKRTFEVCIKDYLKGQYNVSDNSLKKLYHPSMIETYPRVQYTNEHGVYQLGSPRIDSVRNPMAMRSMFRLRKLVNRLLVEGKIDQNTEVHIEFARELNDANKRNAIALFVKENQSANDEARKQIITLFKKETGTDIEPTDKDILKYVLWEEQNHICLYTGKQIRISDFIGANPKFDIEHTIPRSVGGDSTKMNLTLCDSRFNREVKKTKLPVELPNHDEIMERIKEWKKNYELLDIQIRKNKKLSKGATTKEQKDTIIRKRHLLELRRDYWRGKYERFTMESVPEGFSRRQGTDISVISKYARLYLKSLFNRVYTVKGIATSDFRKIWGIQDIYSKKERINHVHHCIDAIVIACIGLDEYNKLGAYYHDEENNKWYGMSKASFKKPWATFVEDIKKIQDEILVYHYTPDNMPKQGRRRIKIDGKKILCKGDAARGSLHNDTYYGAIENDGAVKYVKRIDLASLEEKDVKNIVDDTVRSIIEAAIKEKGFKDAMASTIWMNEEKRVPIKKVRCFTPSITKPLNIRKQRDVSIKEYKQQYHVANDSNYLLALYIGTDNKGKEKREFEIVNILQAAQYYRTSNDKEVVDRHIVPIKSEHDYPFAYTLKIGTMVLLYEKSPNEVWDATIKERNRRLYKVTGLSTMRMKGRNGEYAYATVKLIHNEEARPSKDIKAKNGEYEQGEEFRPAIIMLHTQLNALVQGYDFEINELGEIRRLR

SEQ ID NO: 739 - protein, 1181 aa, Actinomyces sp. oral taxon 180
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 740 - protein, 1070 aa, Sphingobium baderi
MATRLGLDIGTNSIGWCLYDGDSIRDIGVRIFLDGREPSKLTVSGSGTPLAVKRRDARGARRRRDRYIGRRSAMLRELRKHGLLPADPKQAKVLETQDPYALRVRALDEKLEPHQIGRALFHLNQRRGFKSNRKAERASKAGEDGKIATATKLLDEEMQRLGARTLGEFLVKRDSEFDGEAGKRVRMRADSKAYDFYPDRRHVLDEFRAIWNAQKVWHPELLTEQAWNDIFRVIEYQRELKPQVVGHCTFAGINGVPADEKRLPKAHPLFQQRRLYEEVNQLKVVAPGEAGRPLTRDERDALILKLQDKKSVSFETLGKTLKLKDGERFNKESENRKALDGDEVRAALSGKKLFGTRWFHFSAEEQWMIIERLLEEEDSETLLTWLKIGYRLDDEAALAVANAKLPEGHGRFGLSATTALLKELKADVCTYAEAAKRAGFHHSDFRTGEVFDQLPYYGEILAREIAPGKPEYGDENERRFGKITNPTVHIGLNQLTKLVNAIIRLHGKPDYIFVELARELKLNEKEKIAYNRQLKENTDAARDRGAKLGTMGVRDTGRNRLILRLWTELNPGDALNRRCPFCGEQISQRMIQNGEVEIEHIIPYSQCFDDGIGNKVLSHVRCNRQKGDQTPWERWGHDPDRWSIIQEQVAHLHRSKQWRFGPDARDRYAAEEDSFLPRQLIDTQYLTRIAAKYLACLYPERGERHVFAVHGGMTAMLRRLWDLNSILLDHNWVENLNSNAPKNRLDHRHHAIDAAVVGIMTPGLIAEIAKAAARAEKQNLDRLFEELPMPWAQHPNDRRFRDELREKILAATVSHKADHGRQGKPERGRDITAGKLHNDTAYGFTGLTSDTGLPVVVHRVPLTSLTPKDIADPDRIPDTTLRGSLWQATRDLSGKEFEKALLDFSRTHAQFKGIRRVRVREGLTLIPIRNHAGKPYKGYLGDSNARYNVWQMPDGRWVHQVISTFDLHQPGFIEQRPHPAAKKVLSLRQNDLIAIERDGALRQIMRVQKYGQNGQIFLIEHNEAGNMAERNKNTDDPFKFYGPGASALRNMKARQVRIDELGRIFDPGPR

SEQ ID NO: 741 - protein, 1121 aa, Enterococcus dispar
MDRTEVNIGFDIGISSVGWSVVATKSGRILESGVSLFSGASAAKNEERRNFRQSRRLLRRRKNRISDLKKYLKEQSFTYNGELLNENPYEIRVKGLTEKLSKEEIALALLHIVKRRGVSYDLGDIEEEGTTGSYKEGVKKNQKLLKEKTPAEIQFQRLKKFHKVRGQIAIDENDVLLNVFPNHAYVDEAQQILYTQQEFYPEINETFINQVTDFISRKRDYFIGPGSEKSRTDYGIYRTDGTTLQNLFSILIGKDKIFPDEFRAAGNSYTAQVYNLLNDLNNLAIDDTETGKLTKQQKEKIIMELKTTEKSVNMMKLIAKTAGVTVEQISRYRINRDGKSEIHNMAVYRKIRKVFLELGYEINEWPSQLLDELGDALSLNTENGEIRRILTDNLANKYKILDQQLINLIIENKNAFTLSTNQKWHRFSYKTMKILIPELLETNKEQMTILTEMGLMKKDQRNYVGKNKIDSEALLENLYNPVVRKSTRQTMKLFNTLLKKYPNIAYVVIEMPREDDEDKARRDYVKFQKDNEKEKDAALKNFIMESGKSEAEVIAKYRQSKKFRSKVRLWYQQMGRCLYSGKAMPAERVFRDDHFTDIDHVIPLSVSFDDGMNNKVLCLAEMNRQKDKQTPYAFFNAGHGQGFQAMNAMLKNNNRISSAKKRNLLFTENLNDLEVRKRFIERNLVDTRYASRVVLNELQQFVKAKQLDTKVTVIRGKFTSKLREKWNINKSRDTHHHHAVDAAVIAVSPMLNLWEKGASIIPNKVGENVIDIKTGEIITDHDYEADVYELPYAKFLEQIPKVKKDIKFRHQVDKKKNRKVSDATIYTTRKAKVGKDKEETDYVLGTIKDIYSLEGYVSFKKIYNKDKAKFLMARIDPKTFEKLEKIVAEYPESIEVVQDNGKVDVQKISPFELYRKDNGFVTKFAKKNNGPAVKSLKYYDSKLGSSIDVTPDNAKNKKVILQSLKPWRTDVYFNEENQEYEIMGLKYSDLKFGKNGKYGVPKVRYEEIKQEEEISEGSKFLFSLYRGDRIKVTNELGENLDLLFSSRTLPAQKGYVELKPIDKTKFDGKEKVSFYGTVTPNGQFVKKFAKKGYKILKLNTDELGNTYIENGEKEPSDILDM

SEQ ID NO: 742 - protein, 1170 aa, Scardovia inopinata
MAKKKISYRIGIDVGLNSTGLAAIEVDDDGAPIRILNTMSVIHDGGVDPDAAKVRGTRLAISGIARRTRRMRRRRAKRLDRLEQILEKYGYTDTEPVLEEPYGPWICRAELADGFINDDEQRRMMIGIAIRHIARHRGWRNPYQNVRALLNIDDSDLSEEYKNLKEKVQDQINDGKDLPNFTPSQLVRDYLDNFSGQPAARIRTGKAGPRGNRRDAVGILPQRMRQSDYAYELQRIFDMQKIGRDEAQELLMAVFEAKSPKGSAEKRIGKDPLTGKKRALKASLAFQKYRIVATITNLRIKTGTGSERMLSPTELNDIYTYLLRVQDDNHLPTWEDICEEVLHIGRYQLAGIGKTFEGGERISNMPPVIQTSLAIHGLSEGTLAEKLTKWWDKADDDSRESMIKLLSNTVDIDRVNEVDENFASALDFIDSLDDEELTKLDKIALPRGRAAYSEEALNKLTADMLNTGDDLFSARQRIYHVNNSWRPPQPPIGEPLGNPAVDRVLKITNRYLMNCLNRWGQPRRVTIEHTRSGFTSVKQATEHQKISDKRAEYRRDIVKQLEEAGVESVHEYDIRRWEAVQRQNGQCLYCGRDITFKTCEMDHIVPRKGPGSTNTRTNFAAVCPECNRMKSNIPFASWAETKEAKDRGVSLDKAIKQVRFFNFTKNEYSPQAQRNFKKSMIERLKQKTSDEPLDNRSIESVSWMADELYKRIDWYFNHEQYETSKKAINDDKDNLSGTQVVVYPGSITAEARNAAGLGGNIHFIGGRYKTRLDRRHHAVDACVIAMMEPGIARILTERNQLRQAQRLTARIEDDEVNWKDYPTENTAGYNKYQAWSDRMHALLEYMNNALDYDKIPVVRWERLQLGNRSAHEDTIHPLKKLPLSHEISAIDINHASTPALYEALVSLPDFSEQDGLPADPSRQINVNGERYSGDDLVSFFNSNAAQIAIQGGSAELGTAFHHARIYRCWTVGKNGKKKIFFGMIRVYQHDLLHAKNEDLFTYPLKRSSVSMRYAKKEVVHAILSGNAEYVGYLCVGDELVLDLKGDKSNDEGGSRLSGQVGEFVQKFEEDSKVNSQIVNRWTVDGFPDEAKLRLRPSMFAGEGLKNMKSELVENAAIKNILSKTGWRVSVDVISKKSPVVLRRNAFGEPRWKTNAGLPVSYRWQDTETKE

SEQ ID NO: 743 - protein, 1362 aa, Lactobacillus plantarum
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKTYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYREAPKITGLADPKGFNSSLSTYHDFKKILPEAIADEHKRADIEKIILWSTTFEDSAIFKQKLEEVAWLTDAQRKQLSGLRYRGWGQLSHKLLIAFKDDNGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASDNKSKTLVPKKNHMETSVYGGYSNQETAYLAIVRIPFKSGFKFIVVGIPTRMVAKIKHYQSLGATLKQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVANQAHQSFEGLKNNVQKSDKQLGKKEVLNSLFVGLHATATRSNLSVLGMSKDFGRLQSRSGITLTDQAEIIYQSPTGLFERKVALKDL

SEQ ID NO: 744 - protein, 1218 aa, Prevotella buccalis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYHEQGNKVRIRQRYTDRKKHYQHEFDAICEKQELSSELIEDLQRAIFFQLPLKSQRHGVGRCTFERGKPRCADSHPDYEEFRMLCFVNNIQVKGPHDLELRPLTYEEREKIEHLFFRKSKPNFDFEDIAKELAGKKNYAWIHDKEERAYKFNYRMTQGVPGCPTTAQLKSIFGDDWKTGIAETYTLIQKKNGSKSLQEMVDDVWNVLYSFSSVEKLKEFAHHKLQLDEENAEKFAKIKLSHSFAALSLKAIRKFLPFLRKGMYYTHASFFANIPTIVGKEIWNNEQSRKYIMENVGELVFNYQPKHRDVQGTIEMLIKDFLANNFELPAGATDKLYHPSMIETYPHALRNEFGILQLGSPRTNAIRNPMAMRSLHVLRRVVNQLLKESIIDENTEVHVEYARELNDANKRRAIADRQKEQDKQHKKYGDEIRKLYKEETGKDIEPTQTDVLKFQLWEEQNHYCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYHMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTNPKELENIVDETVKRTIKEAIADKNFKQAIAEPIYMNEDKGILIKKVRCFANSVKQPINIRQHRDLSKKEYKQQYHVMNENNYLLAIYEGLVKNKVVREFEIVSYIEAAKYYKRSQDRNIFSSIVPTHSTKYGLPLKTKLLMGQQVLMFEENPDEIQVDNTKDLVKRLYKVVGIEKDGRIKFKHHQEARKEGLTIYSTPYKNNDDYVPIFRQSIKNINILVDGIDFNIDILGKVTLKE

SEQ ID NO: 745 - protein, 1128 aa, Treponema socranskii
MNDKNQKYRLGLDLGTNSIGWCIYSLDVNNKPETLIDMGVRIFSDGRDPKTKEPLAVERRTARGLRRILHRRKLRRRQMFRLLQEQGLMPNDASEAAALKSLNPYELRVKALDTKLEPYELGRALFNLSVRRGFKSNRKEAVQEKEKDSQNDAKSQNEKCEHLAKAIKDSGCRTLGEFLWKHKNTETQQTENDARNIGMRFVPGRSNYYPTRRMYVEEFDAIRKAQEPYYSGVNWDALHEKLFYQRPLRAQERGKCRYMPDKERTFKAMPCSQKIRILQEVYNMDYIDEYGKTIPLEEAQTDSLISLLDKREKLSFKAMKKELGIDESCTFNLERGGREYLQGNAAAVKLRNKKRFGELWDSLSLAKQDAIVEKLITADEDAEIISMLAQYNLTDEQKKNIAVTVLPSGTAMLCKEVTEMLVQKMEQNKIPLTVAVQMLGYTYADQSVREEDTLPYYGAILTGSTMGAHPEADESEPELKYGKISNPTVHVALNQTRTVVNALIKAYGKPQQIVVELSRDLKASREAKARIQKTITMNQKRNERDNKNITDITKIPYPNRNDRLKYRLWEELGSGSNSFSRKCLYCGKPISGSEIFTENIEIEHILPFGRTLFDGETNKTVAHTDCNRDKGDRSPFEAFGSSPNGYNWHEICARANSLKNPAKRTLFAENAMEKFEKDNSFIQRQLTDNAYLSRSALRYLRCICKDVWSINGGMTKLLRDKWNIDSILKRKIDDPEIAHFELKNDQIGQYKKNRYDHRHHALDASVIALIDRAMVQEISQLNKIRLKNRIEAPQMPVLRSELIEKVKHITVSFKPDHGRQGKLSKETLLGKIKKIEKVDIDSIQTDDIASIKDDAIRTRFETKRRELGDITKAKAALKTEFPKLDVFKTYYVSRTPIVSLTEKNINSIVDEKIKEKLKTFIKEHADLSFAEQLQKFSETEWIGKPSAAGKPGKKYRIEKVRCINWGQTPITITSSAVPRYLCPEDYLAAVVWQIPSKKKDTEPEYKATFLRRDEFDVNNKPKKLEKPHDAAQYICMLYKDDYLEFTESGATHLCRIAGLPASQNNKIDIRPIYAVSDCKDWIIATNENMLEPCWKPQKEEKRISVNVLFGKHKARSVTVNPIGRVFRK

SEQ ID NO: 746 - protein, 1391 aa, Kordia algicida
MKKILGLDLGTNSIGWALVNEAEHEHEQSSIVKLGVRVNPLSVDEKTNFEKGRPLSINADRTSKRSARRNLQRFKLRRKNLINLLLKHHIISNETILTEVGKNTTHQTLKLRSKATQEKISLEEFARILLSINKKRGYKSSRKEKNEDEGFTIDGMAIAKELYDNQLTPGQYVYNILQDGKNYIPDFYRSDLQAEFDDVWQFQKKFYSSILTDEFYLKLKGQGKENTRKLFLAIHQVYTAENKGKRDAVKLQYYKWRSEAVKKQLSIEEVAYVLVEINNNINKSSGYLGAISDRSKALYFNNETVGEYLYGQLVKNRHNSLRNQVFYRQDYLDEFEKIWETQAKFYDELTNELKQEIRDVVIFYQRKLKSQKHLISDCLFEKHHKAIPKSSPLFQEFKIWQNLNYLEFVHTQSKEKIFFSELDDETRQFVFAELNIRGTLKIKEIKKLIGLETPVYWKSNFDEIEGNRTNQVLYNVYQNIADDLGYGFDWSKKHAFEINAELQAIFKDVGIDTAILNFDASIEENDFDKQKSYQLWHLLYSAEDTDKATEEDKLIYGNINTKLKKQLHQKYGFEAKYGNLLANISLQQDYGNLSAKAIKKILPYLESGNSFYEACTIVGYNPSNSLTKEQQQNRKLKDKLELLPKNSLRNPVVEKILNQKVNLINQLIDEYGKPDEVRIELARELKKSAKQRADLSKHINDATLKNQNIRKTLQKDFGIQNPSKNDVIRYKLYDELKDNGYKTLFTNKYIPKEQLFSKDVDIEHIIPKAILFDDSFSNKTLAYRNVNLAKADATAFDFISSKHLDDLDNYKARVETLFQSKRISKGKYKKLLMTRQNLPEDFIERDLRNSQYIAKKATAMLKEVFRSVVPTSGRITDKLREDWDLVNVMKELNLPKYRTLGLTEFIERKNGNKIEQIIDWTKRNDHRHHAMDALTVAFTTHNHIQYLNNLNVTHGLNGVDTDHEKSRLYAIKQAITKVYIVGKTKKRKFIPPMENFRSHAKNHLEGILISFKNKNKVVTKNKNRTKTKTKGVFNEKIQLTPRGQLHKETIYGHAKKVIVTKEKVSSKFTHEKILQVTKPAYREALLKRLASFKNDPKKAFSGKNALSKNPLYFDITSGKKVPDTVKLSYFENSYVIRKEVNSDNFKNEKSLQKVLDVGIRRILEKRLADYNGNAKEAFSNLEKNPIWKDKEKGVCIKKVRIEALKNAEPLHVKKDHLGKIILDDENKSTPVDFISTGNNHHVAIYEDKDGKLHDKVVSFYEVVSRVNLGLPIIDKSFNSHLDWKFLFSMKQNEMFVFPSEDFNPKEIDIGNPKNNELISKYLFRVQKFSKVTYGNSAVRDYVFRHHLETELIDKKELKGITYYQLKSIGMLEKLVKVRINHIGKIVHIGEY

SEQ ID NO: 747 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSLEQKEYILAELMTKEFTRFGVNDVVKLLGVKKERLSGWRLDKKGKPEIHTLKAYRNWRKIFAEAGIDLATLPTETIDCLAKVLTLNTEREGIENTLAFELPKLAEPVKSLVLDHYKELSQSISTQAWHRFSLKTLHLLIPELMNATSEQNTLLEQFQLKSGVRTRYSEYNKLPTKDVLAEIYNPTVNKTVSQAFKVMDALLEKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKTNGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYQEFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 748 - protein, 1234 aa, Alloprevotella tannerae
MPNFWSIFTENLQTYLMKTRILGLDTGTNSLGWAVVDRDENNQYTPICRGDLIFTEGVKQEKGIEFSLAAERTSYRASRRHYFRRRLRKVEVLKVLVKHKLCPPLSDEALNRWHTKKEYPLDEDFILWQRTNEADNKNPYHDRHICLHRKLNLKDSQTDRYTLGRALYHLTQRRGFLSNRLDQNEEAEETGKVKSAISELSKEMKEAGCEFLGDYFYLLYRTEGNRVRIRSRYTDREKHYLQEFKEICRVQELDEDLAKALEKTIFFQRPLKSQRQGVGKCTMEKGHSRCAVSHPLYEEYRLLCYLNNIRIKTPSDDRLRPLNAEEREKITPLFYKEKNFDFEKIAKKLAGKTPFGWIRDAEDWPYQFNYRMTQEAPACPTTAQLIKVFGEDWKAALAETYTMSAKQDGTLKTEDEICTDIWNVLYSFSSKEKLKEFGLKKLQLDEVQAKAFSEIRLTRDFASLSLKAIRKILFFLRTGEDYSKAIFLANIPTIVGEEIWNDIERRSRLLYKVDLALRPQEERDAEEHRTIAERIKAAVAAEVPDAPIDLLYHPSMIEAYPDAKRNERFDCYQLGSPKTNAVRNPMAMRSLHMVRKVINHLLRKHIIDEKTEIHIEYARELNDANKRQAIADWQRELSKRHTAYAQNIRQLYKAETGLVIEPTKADILKYQLWEEQQHVCLYTGKKIGIADFLGANPKFDIEHTIPRSRGGDSTQENLTLCESKFNRDIKRDKLPTELANYEEILARIEHWKKQCYALKLKRDGIRTHSGLEKSIKDSRIRRRHLVGLEYGYLKGKYDRFTMKEVPEGFSRRQGAGIGLISKYAGLFLKSLFKDPKNPNRSNVYVVKGAITAEFRKLWGLQQADEAKSRENHTHHCIDAYTIACIGPCEYAALAAYYRSDEEFKYGRRREKPQFEKPWPTFTEDLLKLQEELLIVHQTTDKLGKRDRRKVKTPRGKFLTGGDSARGRLHQETYYGAINYDGNIKYVVRKPLDSLTEKDLDKIVDETVMGIVKGAVEAKGSLKEALADGIYMNKEKGILIKRVRIFSDVSEPINLKQLRDVSTKEYKRHIHLRKDENYLFAIYEGIDKKKNKKQTETATVDYLDAAKFYKDSKRRDKANSLVGDYSKKNKLPLKCILKKRQMVLFYEHSPEEIRFKDKKDLSRRLYIVTSIAKDGRVKFLHHQAATATGIQSSPSPFTNDGEHQPYYRLSASNIKVLVAGIDFDINILGEITPKL

SEQ ID NO: 749 - protein, 1529 aa, Bacteroides pyogenes
MKKILGLDLGTNSIGWAVVNSFDENQNEESLKHIECLGSRIIPMDAAILGDFDKGNSISQTAKRTEFRGVRHLRERHLLRRARLHKILRLLGFLPDHYVQDLDGHGNFLVNVEPKIAWRKDSNGTFEFIFNDSFDEMLQDFATYQPELIACNRKVPYDWTIYYLRKKALTKKLSKEELSWILLNFNQKRGYYQLRGEEDDESVKTAKTRQYFDRQKIKSIVDTNQTYKGQKVLIVELEDGVKGKIFKKEIPNWVGQEKSIIVTVDIDKDGCDKYEESGELSCRFKIPSDAEWESEWKLIKMKTQKDLDASGKTVGAYIYDAILQNPSQKIRGKLVRTIERKYYKEELKQILKKQVEFHPELRDKDLFLDCLNELYPNNDAHRNACADRDFIYLFMDDILFYQRPLKSKKSLIADCPYEKHMYRDKETGELKYSSVKCIAKSHPLFQEFRLWHFISNIRIYQKERVIDVDACQPDLSSARSALKSKLEADVDVTNEFLTCEADYVSLFEWLNNKKSVSQKDFLKYPAFGIKKSGDNYRWNYVEDKSYPCNETRALILSHLEKANIRGDIFTREQEEALWHILYSVEDRYEIVKALQSFAAKYRFNDDFVTVFSKFPPFKKEYGSYSAKAIKKLLPLMRMGKYWSESAIDIKTRERIEKIITGECDDSIRERVRLKAIRLHDIEHFRALPVWLACYVVYDRHSESGDIMKWKTPQEMDSYIQNFKQHSLRNPIVEQVITETLRVVRDIWKQVGRIDEIHVELGREMKNPADKRKEMTKRIIENENTNLRIKAMLTEFLNPEFEIENVRPYSASQQDILRIYENGVLNSVSEIPEEITGILKKFNEREQRKRPSTSEVLRYKLWLEQKYCSPYTGKMIPLGKLFTPAYEIEHVIPQSRYFDDSFNNKVICEAEVNKLKGNLLGYEFIKKHHGQRVDLGLGEIVDIFSVDEYETFVKDYYSGNQQKMKKLLMDEIPEQFIERQLNDSRYISKVVKSLLSNIVREQDEQESISKNVIVCTGGVTDRLKKDWGINDVWNKLILPRFQRLNNITETTEFTAKNMEGHEIPVVPFEYQRGFNKKRIDHRHHAMDAIVIACASRNIVNYLNNESARKKARISRYDLQKLLCDKVRTDDNGNYKWILKKPWGTLTQDVYAALDNVIVSFKQNLRVINKTKNYYVHYEAGKKTIAKQEKGSSWAIRKPMHKDTVFGEVNLRKVKTVSLNEAIKNPQCIVEKDFKKKLLSLLKQNFDAKKVKAYFEEHKDVWSDINLSKIEVYYFTKDTKERFFATRKPLDSSFDKKEIESVTDTGIQKILLRHLEQKNGDPDLAFSPDGIEEMNHNIVQLNGGRKHQPIVKVRVYEKADKFAIGQQGNKSSKYVEAAKGTNLFFAVYEEEVRDKKTNAVMLKRHYASIPLNVAIDRQKKGLSTAPEDENGNVPIFVLSPNDLVYLPTAEDIANASISFPINKNRIYKMVSCTGNRCFFIKHHVANVIVDKSEFSVLNKIEKAETDEMIKEICVPIKIDRLGNIVKIGVYK

SEQ ID NO: 750 - protein, 1084 aa, Subdoligranulum sp. 4_3_54A2FAA
MKNTLYGIGLDIGVASVGWAVVGLNGTGEPVGLHRLGVRIFDKAEQPKTGESLAAPRRMARGMRRRLRRKALRRADVYALLERSGLSTREELAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASILFERQRAMGCSWAAPELQAEYLSILLRQRSFDEGPGGNSPYGGNQVEKMVGRCTFEPDEPRAAKAAYSFEYFSLLQKLNHIRLAENGETRPLTQPQRQQLLSLAHKTPDISLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACTAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVHDYRKRQNLLREKLSGDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYLQDADGAGSQHARTKERFPAPWPRFRDELIVRLSEQPAEPLLDINPEFYCEYGTEHIRPVFVSRMPRRKVTGPGHKETIKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFAYFVSGSISTASITIRTHDNAYGIPSLGVKTLKTFHKYQVDVLGNVFPVHKETRQKFR

SEQ ID NO: 751 - protein, 1060 aa, Cloacibacillus evryensis
MNASILEHYSLGLDIGITSVGWAVLNLTVGKIADLGVRLFDKAEEPKTGASLAAPRREARNMRRRLRRKRQRMSNIRSLIISCGILSQTDMDNLFNSPHQCTPWELRTEGLDRLLTCEEWSRILIHMAKHRGFKSNRTVAESDIKNSEDGRVLSGIKENSELLQAGNNGAGYRTVGELIQSDPKFSGHKRNKGGEYSHTILRKDIEKEIEALFEEQRKFGSTYASMELEKEYKDIFGRQLPFASDGAIEKLIGYCFLEPAEKRAPKASWTAERFILLSKIMNLRVRLDGKKVSLSGDERITIDNLAYKNTKVTYKQIRKALNWQDNLIFDSLPFTKKDKDPEDSVFIELKGWHTFRKCLSEKLGTDYWETISVNPDLLDDLAYTLTFKKTDEDIARYLEERNIDKKIIDAVLPLNFSGVVNLSAAAMGKLIPLMEKDGCRYDEACVKAGYLHYKPAEKERSLKLPVPDWKEIRNPVVIRAIAETRKVVNAVVRKYGPPESVQVELARDLSRSKEERDKIIKEQEENRSQKEKLAKEFQDKFDYAPNGRQLEKFRLWKEQNGFCLYTGQYLAPEDVFNGSDDSFAEIDHIIPYSISFDDSRINKVLATSGANRDKGNRLPYYYFGGDGEKWNEFTARVNANIQNRKKAARLKIKSLDESDISEMKERNLSDTRYITEYVAKWLEENLLFAEKKTENHVTRINGRATATLRWQWGINALKDRESSDLHHALDACVVAAATPGIIKKISDYSRNRELQKLKINAEGNKKRRCPEPWEHFRKEVEARLSENPAEKILEFGLASYSESELNDLKPIFVSRRPDRGATGAAHKDTIYSAKYLNDDPPKIVVKKALTSLKKSDLENIVGKERDRALYEALAKKLEEYEDNPEKAFKDVFRKPTSNGKPGPIVHSVKIFDSRVTGLPVNGGIAFNDGMVRIDLYQKNGKYFLIPYYISDIAKKIVKDKAIAQGKREDDWIAIDETYNFVFSLFKNDLVRIIDSKGREIFGYYNSCDRATGAIEIKKHDGSASWRGIGIRTAKLIEKYQADVLGSYYKIKKEKPPHGLA

SEQ ID NO: 752 - protein, 1506 aa, Prevotella nigrescens
MKTILGLDLGPNSIGWAKVEVDDEGNYLRNIKLGSRIIPMTQDMLGDFDKGVKVSQTAIRTDFRGNRRLIERHLLRRERLHRVLHALKFLPKHYEDAIGWDRNEPATYGKFVNNSEPKLAWERQEDGSMRFLFMESFNEMVADFAQNQPSLVSDGKKIPLDWTIYYLRKKALTRPIKKEELAWILLNFNQKRGYYQLRGEEEEDNLTKRKEYYKLKVVGVEADGAPKGGKTWYNIHLENGWTARCQSKIPLDDWVGKVKEYIVTTEYEDDGKTPKCDKEGKVKRSFKSPEKDDWQLIKTRTEKFIDDSNKTVGAFIYDYLLEKPFDKIRGKYIRTIERKYYKNELREILREQTKYHEGLHSLEALKICAEELYKNNQQHQEYLLKKDMTFLLLNDLIFYQRPLKSKKSLIADCPYEVYKYDDKLTGKKGQKKIKCIAKSNPYYQEFRLWQFIANLRLFSVTDGKEVTAEYLKTEEDYVRLFSFLNDRKDIKQETFLRSFLKLKKESIGSEKIYPIRWNYIEDANKSYPCNATRHELLLAFDRADIPRELLDVEEREYRLWHLLYSIEAKEETESALRKLKANKAFGDLNIDDAFVNSFLKIKPFEKEYGAYSEKAIKKLLAVMRRGSLWKEADICEATKQNIAKILQNDIDEKLKKKIEAAVSSFNKLSDFQGLPTWLACYVVYGRHSEAAQIQCWQSPEDLKTYINKFKQHSLRNPIVEQCLLETLRTVYDIWKDAGQIDEIHIELGRNMKSTAEQRARKTKDILRNENTNLRIKNLLVELKNDDKIENVRPYSPSQQEILRIYEEGALQELSKEDEMFEDISKISKMAQPSPTELSRYKLWLEQKYRSPYTGRVIPLSKLFTTAYQIEHIIPQSRYFDDSFNNKVICESEVNSLKDNMLGYEFIKECGGRIVHCTLLGDVKIFTKEEYKDFVTKHYIDNTYKRDKLLLEDIPQEFSARQLNDSRYISKMVQTVLSNIVRAENEQEATSKFVVSCNGAITNRLKKDWGLNDVWSSIVCPRFKRLNEITKTNAFGHWEDKAGKHVFQTTVPLELQRGFSKKRIDHRHHAMDALVIACASRNIVNYLNNESANSPEKREDLRKKLCDEKRKIRKPWKTFTQDAREALSDVVVSFKNYVRVINKATNYYEHYSSSGNKVMISQKGNDMWAIRKPLHKESVFGRVNLCRKVIVSLKKALENIPAICDKTLRDYINALVEKHFNTRQLLAHFKSINYRLNRQCVEKVEVWQFSDEKIEMVARRKSLDTSFDDKQISSITDTGIQKILLNYLQTKDGNAEIAFTPEGIEEMNKNISLYNDGKAHQPILKVRVATPKGMKYPVGQTGNKATKFVVAEKGTNLYFAIYENELGVRSYDTIPLNIVVERLKEGLSPVPQANEADIPLKFYLSPNDLVYVPTKENEDELCRDRIYKFVDSSGTTANFVPHTSANTIYNVDKEYAEKCCNGAVFLNEYGLGSPQSKNQRALTGEMIKEICWKLKVDRLGNIIKVIK

SEQ ID NO: 753 - protein, 1354 aa, Indibacter alkaliphilus
MKKILGLDLGTTSIGWAFIKEPEKDVVGSEIVDMGVRIVPLSSDEENDFAKGNTISINADRTLKRGARRNLQRFKQRRNALLETFKEKNLIPSNFQYAEDGPSSTFSTLKLRDKAAKEKIELDDFVKVLLQINKKRGYKSSRKAMSEEDEGTAIDSMGIAKELYENDLTPGQWVYEALKNGRKNVPDFYRSDLQEEFKKIVNYQSEFYPDILNTSFVEDWMGKASTPTKQYFNKRGVQLAENKGKREERRLQEYKWRAEAVNFKIDLSEIALILSQINSQISNSSGYLGAISDRSKELYFKNLTVGQYLYQQVKKNPHTRLKGQVFYRQDYLDEFEKIWSVQSSFYPQLNDELKQEVRDVTIFFQRRLKSQKHLISNCEFEEHHKVVPKSHPIFQEFRIWQNLNNLTLIKKDNLNEKCELALEDKTALANELAFKKELSVKDALKVLGLKPSDWEFNFTKIEGNRTNHAFFEAFAKIIELEDGEPIDLGNLKADDILDQFSEAFLRIGIDTELLQVNSDIEGAEYEKQSYIQFWHLLYSSEDDQKLKQNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPNLGRPDEIRVEMARELKANAEQRKNMTSNIASATRDHEKYREILKKEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEITMRVSVTTGTITDKLREDWGLVEIMKELNWEKYDKLGLTYTIEGKHGERLNKIKDWNKRNDHRHHAMDALTVALTKPAYIQYLNNLNAKAIGNKKGTEIFAIEQKYLKRENGKLCFIPPIENIRAEAKKHLSKILVSYKAKNKVVTINKNKTKKKAGFNEQTALTPRGQLHKETVYGKSFHYSTKFEKIGASFDAQKINTVAKKEEREALLKRLAENGNDPKKAFTGKNSLNKMPIYLDLGKNIKLSEKVKTVVLEQNYTIRKNIDPDLKVDKVIDVGIKRILESRLEEFGGNAKLAFSNLEENPIWLNKEKGIPIKRVKISGVSNVESLHVKKDHFGEKILDEEGNEIPVDFVSTGNNHHVAIYEDEDGNLQDEVVNFYEAVIRRNQGESIIKYRHEEGWNFLYSIKQNEFFVFPSQDFNPNDFDLLDPKNYDLISPNLYRAQKFSKVMYGNSAVRDYVFRHHLETVLNDVKELKDVAYKQLKSLQYLNGIKKVRLNHLGQIIQVGEY

SEQ ID NO: 754 - protein, 1374 aa, Streptococcus pseudoporcinus
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 755 - protein, 1372 aa, Filifactor alocis
MLKEEYILTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 756 - protein, 1126 aa, Streptococcus
MTNGMILGLDIGVASVGVGIIEADSGKIVHASSRIFPSANADNNVDRRKFRGSRRLLRRKKHRVKRLQDLFDKYDIVTNFDNLNLNPYELRVKGLNEPLSNEELFASLRNITKHRGISYLDDGEDDSSGNGTEYAKAIELNQQLLKEKTPGQIQFDRLNQYGQLRGNFDIVDENGEIHHVINVFSTSSYRKEAEQILKKQSETNTSISTDFINDFIQLLISKRKYYHGPGNPKSRTDYGRYRTDGTDLDNIFDVLIGKCSFYPEEYRASKTSYTAQEFNFLNDLNNLTLPTETGKLSEQQKIDLVNWAKETKILGPKKLLQEIAKRNNCKFEDIRGYRLDNKDNPDMHVFDVYRKMNFDLETISVKDLSVDSLNQLARILTLNTEREGIEEAIKKLMPNQFTEKQMLELIAFRKSNSSIFGKGWHSLSIKLMKELIPELYHTSDEQMTILNRFGKFKLTKLDSKRTNYIDENSVTDEIYNPVVAKSVRQAIKIINASIKKWGDFDKIVIEMPRDKNEEEERKRIADGQKVNAKEKEQAEKHAAKLFNGKEELPSEVFHGYKELALRIRLWYQQDQKCLYSGKEITISDLIYNRELFEIDHILPLSLSFDDSLSNKVLVYCWANQEKGQRTPFQALDSMKSAWSYREFKNAILHNSKISRKKRDYFLTEQDISKIEVKQKFIERNLVDTRYASRTVLNVLQQSLKNLEKETKVSVVRGQFTSQLRRKWHIDKTRDTYHHHAVDALIIAASAKLRYWKKQGDILFENYLINRHVDRVTGEIQSDDSYKEEVFTPPYDGFVQTISNPGFEDEILFSYQVDSKVNRKISDATIYATRSAKLEKDKKEQTYVLGKIKDIYSQTGFENFLKIYNKDKSKFLIYQKDPETWEKIIEPILKNYREFDNKGKDIVNPFEKYRNDNGPICKYSRKGNGPEIKQFKYYDTVLGKYIEITPESSRNIVALRSLNPWRTDVYFNEKTLKYEFLGLKYSDLNIQNKEEYGISEENYQKIKKEEGVSEESIFKFTLYRNDLIIIKDLSKGKSQIFRFWSRTGKVNEKHKLELKPYNKSSFEKGESLEVIRNLYPSSNQFQEKLNKSDLSIYKLKTDILGNKFISKNENLFPKLIYKKIKRK

SEQ ID NO: 757 - protein, 1127 aa, Treponema maltophilum
MNDKNQRYRLGLDLGTNSIGWCIYWLDGNNKPDALIDMGVRIFSDGRDPKTKEPLAVERRTARGLRRILYRRKLRRKQMFRLLREQGLMPNDPSEATALKSLNPYELRVRALDAKLEAYELGRVLFNLSVRRGFKSNRKEAVQEKEKDNQNDVKSQNEKCERLANAIKDSGFRTLGEFLWKHKNTETQQTENNTRDIGMRFAPGRSNYYPTRRMYVEEFEAIRKAQEPYYRGVNWDALYEKLFYQRPLRAQERGKCRYMPDKERTFKAMPCSQKIRILQEVYNMDYIDALGKAFPIGNAQTDMLIALLDKKEKLTFKAMKKELGIDESCTFNLERGGREYLQGNTTAVKLRNKNRFGDLWDSLSPVEQDTIVEKLITADEDAEIISILEQYDLTDEQKKNIAAIVLPSGTSMLCKEVTEMLVQKMEQNKIPLTVAVQMLGYRYADQSVHEEDELPYYGAVLTGSTMGAHPEQDESKPELKYGKISNPTVHVALNQTRTVVNALIKAYGKPQQIVVELSRDLKASREAKARIQKTITMNQKRNERDNKNITDITKIPYPNRNDRLKYRLWEELGSDSFSRKCLYCGKPISGSEIFTKDIEIEHILPFGRTLFDGETNKTIAHTSCNRDKGNSSPFEAFGSSPNGYNWHDICARANSLKNPAKRALFAEKAMEKFEKDSSFIQRQLTDNAYLSRSALRYLRCICKDVWSVNGGMTKLLRDKWNIDSILKREIGDTEITHFELKDEQIGQYKKNRYDHRHHALDASVIALIDPDMVQAISLSNQNHLINRIKVPQMPVLRSELIEKVKHITVSFKPDHGRQGKLSKETLLGKIKKIEKVNIDSIQTDDDIASIKDDVVRTRFETKYREFGDLTKAKAALKTEFPKLDVFKTYYVSRTPIVSLTEKNINSIVDEKIKEKLKTFIKEHADLSFAEQLQKFSETEWIGKPSAAGKPGKKYRIVKVRCINWGQTPIRIASSAVPRYLCPEDYLTAVVWQMPSKTKNAESEYKATFLRRDEFDVNNKPKKLEKPHDAAKYICMLYKDDYLEFTENGIAYLCRIAGLPASQENKIDIRPIYAASNCKDWIIATNDNMLEPCWRAKEQEKRISVNVLFGKYKAHSVTVNPIGRVSRK

SEQ ID NO: 758 - protein, 1390 aa, Lactobacillus paracasei
MIIRTYELKTITTIAILKMFQLLTGGLSMTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 759 - protein, 1097 aa, Neisseria wadsworthii
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGHLRNKGGEYTHTFNRLDLQKELHLLFERQYALGNPFASAELQSKVDELLMTQRSALQGEAVLKMLGKCTFEPSEYKAAKNTYSAERFIWLTKLNNLRILYNGEERALDEGDRKKLLDEPYKKAKLTYKQVRSILNLPESAVFKGLRYGKDSDGLKAENGTLMEMKAYHKIRTILDKAGLKGEWENRIRNPEILDKIGTAFSLYKTDEDIQAALADLRLPENVLDALLAGLNFDKFIQLSLKALRNILPLMERGIRYDEACKEVYGDHRALAESKNQVLLPPIPADEIRNPVVLRTLTQARKVINAIIRRYGSPQRVHIETARELGKSKQERDKIDRKNKENQNDRNRLASDIRKHFNFEPTPKDILKLRLYEQQHGKCLYSDLREEKGECLYTGNVIELHRLFEDGYVEIDHALPLSRTWDNSLNNKVLVLKSSNQNKGNKTPYEWLDGANNSRRWREFQARVQGCHFPYVKKQRIQTAKLDSKAEQGFLERNLNDTRYISKFMCQFITANLRLAETSNALMEEVAGENPYWKERKRQRVFAPSGSIIALLRGLWGLKKVREDNDRHHALDAIVVACSTVSMQQKITKAMQRRETLETVDSETGEVKTRIPQPWDFFRQEVMIRVFSDSPREELAEKLNSRPEALHDFVSPLFVSRAPNRKMTGQGHLETVKSAKRLSENISVVRKPLTALKLKDIENIVGYPDREPALYQALRERLLAHKDDPVKAFADKPFYKPAKDGGQGSLVKAVRIIENTKHGLKIRNGITDTNGDMVRTDVYQKTDKKGKRQYFIVPVYAWQVEKNELPTVDCKGYEIDDNYEFCFSLYKYDLIEIQNPNDINQELRAYYINCDSSDGRFWLAYHDKSAKEQQFRISTQNQPIIKKYQVDTLGKEIRLCKAEKRTALNGKKKK

SEQ ID NO: 760 - protein, 1038 aa, Bordetella pseudohinzii
MAKQVRYRLSLDLGSTSLGWAIFRLDADAHPTAIIKAGVRIFSDGRNAKDGSSLAVTRRAARSMRRRRDRLLRRKTRMLDALLEYGFFPQDAAQRKALERLNPYALRAEGLARPLTPGEFARAIFHLNQRRGFKSNRKTDKNDNDSGALKTATSQLRQDIQASGCRTVGEWLWTQRLQKKPEGVPHQGVRARYRETPHINSEGKKRIEKKYDLYIDRSMIEAEFDALWSAQATFNPVVFHATAHEKLKDILLYQRPLRPVKPGRCTLLPEEERAPLALPSTQRFRIYQELNNLRLLVDQLNEQPLTLAQRDTIATLMEGRAKISFDQIRKALKLGSMTKFNLEDDKRNELKGNATGSQLAKKEFFGPAWHQFDEALQDDIVWHLLSEENESALISWLQDRTGIDAATAQAVSNASLPEGYGSLSRKALEVILPRLRSEVITYDKAVQAAGFSHHSQLGFEYDPDDVEDWIDHATGEVKPIFKRLPYYGKALQRHVAFGSGKPEDSQEKRYGKIANPTVHIGLNQVRVVANALIARYGRPTEIIIELARDLKQSREQRQQDQRRQADNQKRNARIRNSIAQALGIAEARVRREDIQKWILWEELDPGDAMHRCCPYSGVPISASMLLSEQVEIEHILPFSMTLDDSLNNRTVSLRQANRIKRNRSPWDAREDFEAQGWHYDGILQRAGLMPVQKRYRFAADGYQRWLRDDQDFLARALNDTRYLSRIAAEYLRLVCPQGTRVIPGQLTALLRRRFGLNDILGLEGEKNRNDHRHHAVDACVIGITDHGLMQRFARASAQAREQGLTRLAEEMPLPWPTYRDHVDRAVSLIWVSHKPDHGHEGAMMEETAYGLMKDGTIRQRHKADGTKGREVANVIRIAEPAQPTRHGVDDQGRPLPYKGYIGGSNYCIEITRGAQGKWEGTVISTSDAYGIVRARGIAGLRNTSQGQNGHPLVMRLVIGDSLRLRINDALQTMRVTKISGNGQVFMAGVHEANVDARNRDKSQAFALVSKMAGSLQAAQARQATISPIGEIRDPGFPG

SEQ ID NO: 761 - protein, 1446 aa, Flavobacterium suncheonense
MARILGLDLGTNSIGWAIVDKNGTEFSLVDKGVRIFSEGVKSEKGIESSRAAERTNYRSARKIKFRRKLRKYETLKVLSQNGMCPLSVDEVNGWRKSGFKQYPLNPEFLKWLRTDDNQNINPYIFRDRASRQKVSLYELGRALYHIAQRRGFLSNRLDQSADGIIEQHAPNIESRIEEAQTVNDLMVEIEDYFDGLDILEKNSKDLDEGEKKLKSLYNALEKIIKSNDFEKAKAEVIARLNRKEDQGAVKQEIGEISKAMKDGNFGTLGQYFYSLYSKGKIRNHYTAREEHYLAEFEIICKAQGITEINENEKLPEKRYSGLAKELYRAIFFQRPLKSQKGLIGKCSFEKNKTRCAISHPDFEEYRMWSYLNTIKIKTPEDEKLRFLTLAEKQRLIPKFLRKKDNFNFEDLAKELIVKGTTFEFYKSSNAKSAHYLFNYKPKDTVPGSVVSASLKNIFGDDWNTKQWNYQTQNSKGETVTRTVYYKDIWHLLSVSTSDIYLEEYAKNKLGLDEKRAKSFSKIRLKKDFASLSLNAIAKITPYLKQGLLYSHAVFMANIENIVDEHIWNNPKERLYIQNKIAEIIDDNTLENSKLEIINGLIKECKADNCYYSKEAEHTYKNDLQKKVATIFRNNEDQDDIVEELFPIFIIQLQKHEYIPIKRLDEKVIEFLKGENEDGEIYCSNQNRLHKLYHPSDIEVFKKKIIKDEFGNEKVVLGSPLISSIKNPMAMRALHQLRKVLNTLILEGLVDEKTKVHIELARELNDANKRKAIQDFQKENQNKRQDLAKQIKEDYKAQTGKDIEPTEDDILRYQLWVEQNGMEIYEPTLNGGVSKKIGIHQIIGENPDYDIEHTIPRSISQDNSLMNKTLCSKRFNRDIKKNQMPIELNNYELLLPYIDHWRKEADKLTWEIEQIIKSTKAAATKEAKDKKIRRRHYLTLKRDYLKGKYERFVWKEAKVGFKNSQIPDTGIITKYSRAYLNSYFNRVESVKGGMVAEFRKIWGLQPSFIKDGKKYYEEKDRSKHTHHTIDAITIACMTKDKYDVLANAWTKEDNENGNEARKLLSESKPWPTFTEDLQKIEGEILVSHHTPDNVKKQSKKIVRVRGKKQYIAEIERDINGKAVAKKDGNGKIIYKLDCNGKKLPRIQQGDTIRGSLHQDSIYGAIKNPLNTTEIRYVIRKDLESLKANDIENIVDEIVKEKVKQAIANKVLLLSSNTQQKNKMSGTVWMNEEKQIPINKVRIYANSVKNPLEIKEHSLLSKSKHEHKQKVYGVNGENYAMAIYEGQDKKGNLKRGFELLNYMDAGNYYKLSNDSKNHNTIVPAIHLKLDLPLKYIIKKGDLVLFYEESREELSEVGDKEFMKRLYKVIGFEGDGRIQFRHHKTAMQQSSANKEELTIVKFMADNNLKNSQVDFDTPVPWLRLRVSNCDFLLNDKEFKINPLGKVAIL

SEQ ID NO: 762 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 763 - protein, 1458 aa, Fluviicola taffensis
MTKTILGLDLGTNSIGWALINQDFDNKKGEILGMGSRIIPMTQDIKDEFGKGNSISQTAERTRLRGVRRLIHRTLLRRERLHRVLNIIGFLPEHYANQIDFEKRFGKFKPESEPKISFDGNDVFLFEKSYQEMLVDFKIHQPQLVSNGKKIPHDWTIYYLRKKALSKKIEKEELAWILLNFNQKRGYYQLRGEEEEETPNKLVEFHSLKIVEVNADEPQKGKPEIWYSLVLENGWVYRRASKTPLFDWKDKIREFIVTTEINNDGTVKTDKEGTEKRSFRAPKPEDWTLQKKKTEFELSKSGNEVGAFIYESILQKPNQKIRGKLISTIERKFYKEELKTILKTQLFFHKELKDEKLYNACIEELYKNNEAHRSLLSNKGFEHLFINDILFYQRPLRSKKSQISNCPLEKRTYKKEGIEITEGIKVISKSNPIYQEFRLWQWISNLSLYCIEPTETNVTSTFLNSIEDYENLFEFLNNRKEIEQKHLLKYLLENQGFKGKLLTNELEKFRWNFVADKKYPCNETGSLLHTRLSKVKNISPDFLTKEIEHQLWHIIYSVTDKIEYEQALKTFARKNNLDVDSFFEHFKKIPPFESTYGAYSEKAIKKLLPLIRLGKYWNWEAIDSISKDRISKILSGEYDENIKNRVREKAVHLTSENNFQGLQEWLAKYIVYDRHSEGNDLGKWTSVSDLETYLKEFKQHSLRNPIVEQVITETLRVVKDIWIKHGKGTENFFDEIHVELGREMKNNSEDRKRLTNTITENENTNLRIKALLMEMMNDNDVENVRPYSPSQQEILKIYEDGALNSNIELDDEIVKISKKAEPTKSELQRYKLWLEQKYRSPYTGQVIPLNKLFTSEYEIEHVVPQSRFFDDSFSNKVICESAVNKRKDNQLGLQFIKNHSGEKVELGFGKVVQVFTEEQYLDFVKEHYSKNRSKHNKLLLEEIPEKMIERQLNDTRYISKFVSSILSNIVRSEKDDDGLNSKNILPGNGKITTELKRDWGLNDVWNDLILPRFERMNTITNSDLFTTYNDKYQKHLPTVPFEYSKGFQKKRIDHRHHAMDALVIACATRDHLNLMNNQSAKSELKRYDLQNKLRKKEPYFNQKENKQKEAFKDFIKPWGTFTEDSKNALEKIIISFKQNLRVINKATNSYESYKDEDGNLRIGKDGKPEKGLIKQKGLNWAIRKPLHKDTVSGQINLSRIKLPNGKILTATRKNLDTSFDLKTIENSITDTGIQKILKNYLLSKESPELAFSPEGLEEMNNEIEKYNNGKFHHPINKARIYELGSKFNVGQTGNRRDKFVEAAKGTNLFFAIYQDENKNRSYETIPLNEVIEHQKWRASLPKEEQEKIPLVPVNKLKGTFIFSLSPNDLVYVPSNDELERSASIDFSKLKKEQINRLYKMVSSSGSQCFFVKSEVATSVVNKMEYSSLNKMEKSIDNLMVKEICIKLKIDRLGNISKA

SEQ ID NO: 764 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 765 - protein, 1383 aa, Bifidobacterium angulatum
MGRKVAAEDYAISLDIGNGSVGWAAFTPDYRLVRAKGHELIGARLFEPAQTAEARRMARTTRRRISRRRWRLRLLDALFDAALSEIDPSFLMRRKYSWVHPNDTNNAERWYGGILFDSKDQDKRFYEKYPTIYHLRRALMEDNEQHDIREVYVAVHHILKYRGNFLIEGELDSSDVFVTKKLLNLVKNIINQTSENELEESWALNVDEVKFADALCTTRGSRKMRADNALALIQNACDLTKEQIALVKAILSGLEGNKLDLNKIFPLEGRSSEDQKALSVYFNKADYEETRAKISDSGLLGDDECAFLDELQEQYSAVALKQLLGDSTSISESMCESYDHHRKNWELIKKELRTEDNAEEINRHYGAIVGWEIVDGQRKSIRSSNEDKRKKANKYFADLIGNSSLNESIKRALEHDIEEDQLFPIQRNSDNGVIPYQLHLNELRQILHNQGEYYPFLLDTFEKNGKKVNKIEGLLTFRVPYFVGPLVEQTDMQSSDNAENHWMKRKKAGTITPWNFDEMVDKDLSGRRFIDRLVDTDSYLLGEPTLPKNSMLYQEYEVLNELNNVRLRARSGSHWSDKRRMRLGHEEKAVLLDLFKQHGTVTKNAAENALRRKYGCTFELSGLSDEKKFTSSMSTYNKFSRIFGKEYVREHFDLMEQIVELQTVFEDKETLWHQLSLLDGLSDRDCDLLCKTHYTGWGRLSKKLLTTRVGECKLGNDFAPQKHSIIEIMRAEDRNFMEIITDKELGFSEWIDAQNLGVDKNQTLESVVDELRISPKVKRGIIQSIRLIDDISKAVGKVPSRIFMELADDIQASVRTTSRKNFLLNLYKNSGLKKEFSDIFERLESTDDKELQDDRWFLYYTQLGKDMYTGKELNIDRLSSDYDIDHIIPQAVTQNDSLDNRVLVSRAANARKADSFAYLPELVSARKNFWQELLDNHLISPIKFERLTRQNDFGTHERDRFVQRSLVETRQIMKNVATLLRKRYGNSSSVIGLNAELTKEMRHYLGFGHKNRDINDYHHAQDALCLGIAGQFAVNRGFFDNGMVSDGAKNSYNRYLQDYLKGYRDQLKAGDRKHGRAFGFVVGSMASSDENKRVNPKTGEIVWTEHDKEYLRRVMNYRKMLVTQKVGDNFGPLYNETRYGAGVKEGRDGIAFGKNKADTSLYGGFSSAKVVYSVLIELKKKVQLVNITMQEYAILGDRPSDDALRNVLVAKKKEYSKARFLLRHIPQMQLIRYNNAYMVIKSATELNNARQLWIDHRVYDALDDYLKKGVSRNGVDTVTVWDMLFKAVEKGYPLHVIERNVLDDARVKFMELSLAEQIDVLGLIVIALHADPRRANLRIVGLPSEWKRIRSVSFSDNDEFIFQSPSGLFEKRVTVAELRRKAK

SEQ ID NO: 766 - protein, 1354 aa, Flavobacterium psychrophilum
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 767 - protein, 1370 aa, Lactobacillus wasatchensis
MKKRNYNIGLDIGTSSIGWTIVDDNAQIMRAKGKNGYGVRIFAEGKTAADRRGFRTTRRRLKRRKWRLRLLQEFFEPYILPIDENFFMRQKESNLVPQDPNKHFKGSILFNDRTDQEFHEQYPTIYHLRYALMTEHRQFDVREIYWAIHHIVKYRGHFLNSTLASKFKGGELRLADKFESLNKLFLRVQAETGFELSEDNVDKIKTVLLDNGKSRLDRQREVLKIVYLTSEDKDTEKKRKAVATEFIKAVLGLKTKLFIVLAKNPTAETDWKFSFDAEDIDDKLDSISEQLTDDDHEIVELISEIHSIITLTGVVPEGMGLSESMIAKYDQHQLDLKKLKSLMRDLDVKQARKLQDAYDEYIDGLKPSEEAFYSAVSSVIQKMDDPRAKKITAEIELEEFMPKQRTKANGQIPHQLHQQELDQIIENQKEYYPWLAEENPNKREHNAAPHKLDGLVTFRVPYYVGPLIEASVQQKTSNSNFAWMERKVKNDTSRITPWNFEEKVDRNASAENFIKRMTTKDTYLLNEDVLPQQSLLYQRYEVLNELNNVRVNDKKLENNCKQDVYKDLFKNNTTVSIKKFKDYLVANCEYADNPKIEGLADESIFLSSLSTENKFKDIFGAQIDDPNYFEDFEHIIEWATIFEDNKILRAKLDEISWLNESQKKELAKLRMRGWGRLSRKLIAEITDENGSRIIDLLWEHMDNFMVVVNQDVFKEKIVAENKQVFKELNPLDIINEQFTSPQNKKALRQILLVVADIQKAMNGVTPSNIFIEFAREDERNPRRSIQRLRQVENMYRDISDTVLADPEVRNELSNIKNTELARDRVFLYFLQGGRDVYTGEPLNIDKLSEYDIDHILPQAFIKDNSLDNRVLVSASLNRSKSDSVPLDDFTSEMFGRKMEPLWEQMQRAGLISKKKLANLKFNPENINKYTRNGFINRQLVETRQVIKLAANILKDHYGEETEIVNVKAGLTHQFRKDFDFPKNRNVNNYHHAFDAYLTALVGTYLLKKYPKLESYFVYGKFKKGDGITNLKNFNFLHGFNKPGKIINKETGEILFDRDKQLGYMNSIYDLRKVIVTHELSTRHGAMYDQTLYKASDDKDSGRGGKQLIRKKDNLPTEIYGGYTGSTDAFMSIIRMKKKDKLYYKVIGVPTRVAHEVLQSDGKINIFTLNKFIEQKLTKEKVNKKTGAITRITDWFELVIAKVMYGQVIDDGGQPFMLGSSTLPYNVRELYLAKDLVKVINKGSTSKSSYLDVYDELVKSLNKYFPMYDRNMFRQKITDARDKFEKLPKRDKVSNGKLQQIGQVTIIDRILIGLHTNAGVSNLKDLGIATPFGFMQQGNGISLTSTAKIIYQSSTGLFEKSKALDDLNPLA

SEQ ID NO: 768 - protein, 1435 aa, Capnocytophaga sp. oral taxon 329
MKNILGLDLGTTSIGFAHIVEDENKEKSEIKELGVRIVSLATDEQSDFEKGKSISTNANRTLKHGARLNLDRYQQRRKFLIDLLQKANLITSASILAENGKNTTHSTWQLRAKAVTERIEKEEFARVLLAINKKRGYKNSRKTKTEDEGQAIDGMAIAKCLYDENLTPGQLSLQLLQQNKKLLPDFYRSDLQKEFDLVWNLQKQFYPDILTDSFYKELQGKGKDATSKAFSKRYHFDTAENKGSKESVRLQAYQWRAEAISKQLSKEEVAYVLTEINNNLNNSSGYLGAISDRSKELYFNRQTVGQYLYAQLQENRHNSLKNKVFYRQDYLDEFERIWETQASFHKELTDELKKQIRDVVIFYQRKLKSQKGLVSFCEFESKEIEIEKDGKAITKSIGARVVPKSSPLFQEFKIWQILNNVTCKRKGIRKKKSSAKSTELDLFNEPSQSIFSLDMECKQLLFDELNLKGDLKSDKVLKLLGYSPQEWEINYNQLEGNRTQKSLYEAYLKIIEIEGYEVKDILQIKSTKDDWSLDESPLSASEIRERVKVIFQTLGICTKILYFDPLLPVKEFEQQYSYQLWHLLYSYESDDSTSGNETLYRILEKKYAFKREHATILANVALQDDYGSLSTKAIRKIYPYIKENQYSTACELAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISEKLQKQFGIKNPTKSDIIRYRLYQELEHNGYKELYTNTYIAPDVLFSKNIDIEHIVPKARVFDDSFSNKTLAFKEFNIKKGESTAFDYITSLNCEGELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKDGNKVTVIKDWTKRNDHRHHAMDALTVAFTKPSYIQYLNHLNARKDENNKNYSVILAIEKKETIKVPINNGKNKRVFIEPILNFRQVAKKHLEEIFISHKAKNKVVTKNINKPAGTDKQQITLTPRGQLHKETIYGKYQYYVNKEEKVGVKFDERTITKVSNPLYREALLKRLQANDNDPKKAFAGKNALSKNPIYLDEAKTKTLPEKVNLTYLEEDFSIRKDISPDNFKDLKSIEKVIDQGVKRILIKRLQAYDNDPKKAFVDLEKNPIWLNKEKGIAIKRVTISGVSNAQPLHIGKDHLGKTTLNKEGKEVPVDYVSTGNNHHVAIYRDKEGNLQEQIVSFFEAVVRAQQGLPIIDKNYKQAEGWQFMFTMKQNEMFVFPNEATGFNPAEIDLLDPKNKKLISPNLFRVQTISIVKYGNSVVRDFKFRHHLETTLQDDKILQGITFQQIKSLEPLRNIVKVRINHLGDIVNIGEY

SEQ ID NO: 769 - protein, 1152 aa, Lactobacillus salivarius
MEDMERYHIGLDIGTSSIGWAVIGDDFKIKRKKGKNLIGVRLFKEGDTAAERRGFRTQRRRLNRRKWRLKLLEEIFDPYMAEVDKYFFARLKESNLSPKDSNKKYLGSLLFPDISDSNFYDKYPTIYHLRRDLMEKDKKFDLREIYLAIHHIVKYRGNFLEKVPAKNYKNSGASIGFLLEEVNDLYGNIIGNEDVAILDNDKFEDVEKIILNDEIRNIDKQKNVGRLLVKDKKEKNIVTAFSKAIFGYKFNLEDLLLIESDEKNKLTFNDENIDDIFNELSHSLNDNQMDLLTKTREIYFKFKLNMIVPTGYTISESMIEKYEMHKAHLKMYKEFINTLNAKDRKILKNAYSDYINNEKAKAANAQENFYKTVKKTIKENDSDTAKKIIGLIDEGNFMPKQRTGENGVIPHQLHQIELDRIIENQAKYYPWLAEENPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKYKVLNELNNIKVNKKKLDVEQKQHVYLDLFTTRKNVTKDDLATSLNCDVESITGLTDNKKFNSSLSSYIDLKAILGNIVDDYSKNEDLEKIIEYSTIFEDGNIYKEKLSEISWLTDEQIEKLSNIHFKGWGRLSKKLLTQITNENGERIIDTLWNTSNNFIQVISDESIQAKLAEINGEYANKYNLEDILDEAYTSPQNKKAIRQVMKVVEDIEKAMKCEPTSIAIEFTREKRKSKLTNTRYKKISETYEKITDELISEYELGKLQSELDSKVNNMRDRYYLYFMQLGRDMYTGEKMNIDELHQKYDIDHILPQSFIKDDSLNNRVLTSKSVNIKEKSDKTAADLYAAKMGDFWRKLRKQGLMTEQKYKNLLTRTDSINKYTKQSFIKRQLVETSQVVKLAANILQDKYRNTKIIEIRARLNSDLRKKYELIKNREVNDYHHAIDGYLTTFVGQYLYKVYPKLRSYFVYDDFKKLDSNYLKHMDKFNFIWKLEDKKAEDVYDKVNDEFVLNVPEMKEYIRKIYNYKYMLVSKEVTTKNGAFYDQTKYNAKTINLIPIKKDKPTNIYGGYKGKVSSYMMLVKIQKKKEVIYKFVGVPRLWTDELDRLIDTDEKKALLKK

SEQ ID NO: 770 - protein, 1391 aa, [Eubacterium] yurii subsp. margaretiae ATCC 43715
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 771 - protein, 1507 aa, Flavobacterium branchiophilum
MLQIYKTFLNVYSEKTFFLKYFFQYIYKKYENTKMAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHNQFTAFVEGIDFKVLPSGKFEKI

SEQ ID NO: 772 - protein, 1375 aa, Lactobacillus ruminis
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 773 - protein, 1646 aa, Francisella hispaniensis
MNIKILPIAIDLGAKNTGVFSAFYQKGTSLESLDNKNGKVYELSKDSYTLLMNNRTARRHQRRGIDRKQLVKRLFKLIWTKQLNLEWNKDTQQTISFLLNRRGFSFITDGYSPEYLNIAPEAVKAILMSILDDYNGEDDLDSYLQSATENDSKIDELYNKLLQKALEFKLRKLCIDIKEDKVTTKTLKELSNTEFKLLANYLVDYDRILRTQKFSYTDKQGNLRELNYYHHDKYNIQEFLKRNIIINDVILEKLTDDLDIWNLNFDKFDFEKNLEKLENQEDKDYLQTHLHHFVFAVNKIKSEMASGGRHRSQYFQEITNVLVENNHQEGYLKNFCENLHNKKYSNLSVKNLVNLIGNLSNLELKPLRKYFNDKIHAKADYWDEQKFAETYSDWILGEWRVGAKDKDKKDGAKYSYKNLCDELKQKVGINQDGIINQTKSDFVDFLLELDPCRTIPPYLDNNNRKPPKCQSLILNPKFLDNKYPNWQQYLQELKKLQTVQNYLGNFEIDLKDLKSSKEQPYFVKYKSLNQQIASGQRDYKDLDARVLQFIFDRVKASDELLLNEIYSHAKKLKQNTSSELEKLELCKKLDEVIANSQLSQILKSQHVNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNQASKLEFDRKIKKFNSIYSFAQIQQIAFAERKGNANTCAVCSADNAHRMQQIKVAKPVEGNKDNIILSAKAQRLPAIPTRIVDGAVKKIATILARNIVDDNWDNIKQALSNNQQLHVPIITESNAFEFEPALADIKGKSLKDKRKKALERIDPENVFKDKNNRIKEFAKGISAYSDANLANGDFDGAKEELDHIIPRSHKKYGTLNDEANLICVTREDNQNRGNKAVFLYDLKPNYKLKQFNTTDDLEIEKKIADTIWDASKQDFKFGNYRSFINLTPQEQIAFRHALFLADKNPIKKAVIRAIDNRNRTFVNGTQRYFAEVLANNIYLRAKKENLATNRITFDYFGIETTNSNGRGIADVRKLYEKVDSDIQAYAKGDKPQDSYSHLIDAMIAFCVAADEHKNEGSIGLKMGNQYGLFPTPDKYDENTGEIISWHNDDIFRKIKVSDNQFSDKKLVRKKATEGFNTHRQMTRDGIYGESYLPILIHKNLNEVRKGYNWENSEEIKIFKGKKYDIQQLNNLVYCLKFVDKPISIDIQITTLEELRNILETNNISTTAEYYYINLKTQKLHEYYIENYNTALGYKKYTKEMEFLRSLAYRTERVKIKSIDDVSMILAKDSNFKAGKIELPFKTEWQRLYLEWQNTTIKDNHEFLKSYFSVKNATKQHKKVRKDFSLPISTNEGKLLVKRKTWDNNFIYQILNDSDSRADGTKPFIPAFDISKNEIVETIIKSFTSKNIFWLPKNIELQKVDNKSIFAIDTSRWFEVETPKDLIEIGVSTIQYKIDNNSRPKVRVKLDYVMDDDSKINYFMNHSLLKSRYPDKVLEILKQSTIIEFESSGFNKTIKEMLGMTLAGIYNETSNN

SEQ ID NO: 774 - protein, 1339 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 775 - protein, 1145 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKCHYLKMVNL

SEQ ID NO: 776 - protein, 1158 aa, Barnesiella viscericola
MKNILGLDLGSSSIGWAVIHEDDTHGELVTMGSRIVQLSPDELSSFTQGNGVSVNAQRTQARGQRRGYDRYQLRRALLVEKLRELDMLPDVSLTGLPKLELWGLRARAVTERIGLRELGRVLFHLNQKRGYKSTKSDFSGDKKTTDYVKTINNRYDDLQAAGLTVGEHLYRELSANPFYRCKEQVYPRRAYVEEFDRIMACQQAYYPSLLTDEQIRCLRDEIIFYQRPLKSCKHLVSVCEFEKRRYVNAAGKEVEAGPKVAPRTSPLFQLCRMWESINHIVVRNRQNEILEISLEQKNQILAFMNTHEKLRITNLLQLLGLPKSGGYRFGDQFKAGIQGNKTRIDIATALGDYPDKERLLQFNVREISSSMVDEETGEILPIIDPSFEQEPLYRLWHVLYSIDDRDQLQAVLRRQFGIDDEEVLARLSALDFVKAGFGNKSSKAMRRILPFLRLGLNYADACAAAGYNHSNSMTKAENEARELLDRIPAIRKNELRQPVVEKILNQMVNVVNALMAKYGRFDEIRVELARELKQSKEQREKSYKSMLSTQRENERIAARIAEYGVVTRSRIQKYKLWEETDHCCIYCGQPVDVHDFLQGFGVEIEHIIPKSLYFDNGFANKVCACRRCNSEKGNSTAYDYMSHKGASLFQAYVDRVNDLKSRNKISENKMKNLLTKVENIPDDFIARQLKESQYIARKSRELLSMVCCQVTATSGSVTDFLRHTWGWDTVLHDLNLPRYREAGRTEIKEVQHKDKEQIVGWTKRLDHRHHAIDALTIACTKQGYIQRLNNLSALGKKAEGEEAASGSENGSQNLERYIQAQPHFSVAQVREAADRILISFKAGKKSVTPGKRYIYKNGKRVVAQRGLLVPRGALSEESVYGVVRLWEKDDRGNRVQVQRAVLKYPVTSIDSKSLDKVFNKGIREILSNRLEQYGNDPKKAFATPVYSDAEGRRPIRTVRCLARPAVDTLVPLRYDRDGKPIAWVNPGNNHHVAIYRDEAGKYREQVVTLWNVVDRRRAGLPAIITDPRAVWDSVLQRTDLPEPLLKSLPDVKWQFVLSLQQNEMFVLGMSDEDFRYAMDHHDYALLNKYLYRVQKVSKGDYFFRFHVETMVDDKYDGKTNMALSIRMGKLKRVSVKSLLSLNPYKVHLSVLGEIDEVL

SEQ ID NO: 777 - protein, 1063 aa, Staphylococcus microti
MEKDYILGLDIGIGSVGYGLIDYDTKSIIDAGVRLFPEANADNNLGRRAKRGARRLKRRRIHRLERVKSLLSEYKIISGLAPTNNQPYNIRVKGLTEQLTKDELAVALLHIAKRRGIHNVDVAADKEETASDSLSTKDQINKNAKFLESRYVCELQKERLENEGHVRGVENRFLTKDIVREAKKIIDTQMQYYPEIDETFKEKYISLVETRREYYEGPGKGSPYGWDADVKKWYQLMMGHCTYFPVEFRSVKYAYTADLYNALNDLNNLTIARDDNPKLEYHEKYHIIENVFKQKRNPTLKQIAKEIGVNDINISGYRVTKSGKPQFTSFKLFHDLKKVVKDHAILDDIDLLNQIAEILTIYQDKDSIVAELGQLEYLMSEADKQSISELTGYTGTHSLSLKCMNMIIDELWHSSMNQMEVFTYLNMRPKKYELKGYQRIPTDMIDDAILSPVVKRSFKQAIGVVNAIIKKYGLPKDIIIELARESNSAEKSRYLRAIQKKNEKTRERIEAIIKEYGNENAKGLVQKIKLHDAQEGKCLYSLKDIPLEDLLRNPNNYDIDHIIPRSVSFDDSMHNKVLVRREQNAKKNNQTPYQYLTSGYADIKYSVFKQHVLNLAENKDRMTKKKREYLLEERNINKYDVQKEFINRNLVDTRYTTRELTTLLKTYFTINNLDVKVKTINGSFTDFLRKRWGFKKNRDEGYKHHAEDALIIANADYLFKEHKLLKEIKDVSDLAGDERNSNVKDEDQYEEVFGGYFKIEDIKKYKIKKFSHRVDKKPNRQLINDTIYSTRVKDDKRYLINTLKNLYDKSNGDLKERMQKDPESLLMYHHDPQTFEKLKIVMSQYENEKNPLAKYFEETGQYLTKYAKHDNGPAIHKIKYYGNKLVEHLDITKNYHNPQNKVVQLSQKSFRFDVYQTDKGYKFISIAYLTLKNEKNYYAISQEKYDQLKSEKKISNNAVFIGSFYTSDIIEINNEKFRVIGVNSDKNNLIEVDRIDIRQKEFIELEEEKQVNYMNSDSYLKNNRIKVTIGRKTTNIEKFHTDILGNMYKSKRPKAPQLVFKKG

SEQ ID NO: 778 - protein, 1422 aa, Prevotella denticola
MTQKILGLDLGTNSIGSSVRNLDLSDDLKGQLEFFSSDIFRSSVNKESNGREYSLAAQRSAHSRSRGLNEARRRKLWATLDLLIKYGFCPMSPESLMRWRTYDKQRGLFREYPIDDKDFNAWILLDFDGDGKSDYSSPYQLRREFVTRQFDFDQPIERYKLGRALYHIAQHRGFKSSKGETLSQQETNSKQSLTDEATDVAGEMKASEEKLSKGLSTYMKENNLLTVGAAFAQLEDEGVRVRNNNDYRAIRSQFQREIETIFKFQQGLSVENELYERLVSEKKNIGTIFYKRPLRSQRGNVGKCTLERTKPRCAIGHPLFEKFRAWTLINNIKVRMSEEEQAEQLPMKLRFELYNDCFLAFVRAEFKFADIRKYLEKRLGVHFSYNDKTINYKDSTSVAGCPITARFRKILGEDWESFRVDGQKQRQAHGKNNASFHRVSYSIEDIWHFCYDAEEPEAVLSFAQDNLKWEKKKAEELVRIWSAMPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGERWKKLYHPSQIAIYRPVPANKDRSALRLGNPDIGAIKNPTVLRVLNTLRKRVNQLLDDGIISPDETRVVVETARELNDANRKWALDTYNRIRHDENEKIKKILAEFYPKRDNISTVDIDKARYVIDQREMDYFTEAKTYHKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRVQNKDRKDQCMREMHLWKMELEYWTKKLERFTITEVTDEFKNSQLVDTRVITRHAVLYLKSIFPHVDVQRGDVTAKFRKILGIQSVDEKKDRGLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQFAKDKDGKVLLKEGHPLVDPTIKFVIRRELKYKKSTADSGFASWDDLEKAIVDKELFALMKGQFPEETSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 779 - protein, 1059 aa, Rhodovulum sp. PH10
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 780 - protein, 1053 aa, Sphingomonas sp. MM-1
MSGMVFGIDLGIASCGWAVLRQPQRDGDPGEIVDLGSWMFDVPETDKERTPTNQVRRGNRLLRRVIRRRAQRMVEIRRLFHDHGLLAGHAPEALKRAGLDPWDLRARSLDKVLEPAALAVALGHIAKRRGFKSAARRKEANTAGDDQKMLKALEATHERLGRYRTIGEMFARDPDFESRKRNRDGMFDRTQGRDDLLHEVGEIFKAQRRLGSALATAELEQAFTAIAFRQLPIQDSERLVGLCQFEPKEKRAARFAPSFERFRLLQRLTNLRVVTVEGERPLTADEIAAAAADLGRTAKLSVKEVRKRIGLAADHRFAAFKADEEDRDIIARTGEALHGTYRLRKALGEGLWAEMLPGQLDAIAHALSFFETQDVILKELDKLDLPAGVRDAIATGLDAGAFARFKGTGHISARAARALLPHLEAGLRYDQACTKAGYDHAASRWAKREQVADKAAFNRLVTDMGAEIANPIARKSLTEALKQLWAMRNRWGLPDAIHIELARDVGNSLEKRREIERAIEKNTAARERERGEARDLLGIDDVSGDTLLRYRLWKEQAGRCPYTDAPIPPGAIIATDNSFQVDHILPWSRFGDDSFANKVLCATAANQRKKGQTPCEWITAAQGEEGWATFVARIEGNAAFRGPKKRNYVLKNAKEAEERFRARNLNDTRYAARLLAEAVKLFYPEGERQDKGGVRRVFTRPGGLTAALRHAWGVEALKKRDGKRVDDARHHALDALVVAAIGEGEVQRLTRSYQEWEQQGLARPLRRVDPPWGDFHSFRREVKDAYDGIFVARPERRRARGEGHAATIRQVRERDGAAVVFERKAIADLSEKRLADIKDPERNQAIVEAIRQWIVDGRPADRLPRSPAGDEIRKVRLRTKGKPAVQVRGGAADRGEIVRVDVFTKPNKKGKNEFYLVPIYPHQVMNKAEWPTPPMRAVVAYKDESEWTLLDENFGFLFSLFPRSYVEVTKPGGEVLSGYFQGMDRSTGAISLFNHRDSRSLTDDSGNSTRGIGAKTLLTMKKYSVDRFGKRAEVKSEVRTWHGVACTYPTPPG

SEQ ID NO: 781 - protein, 1509 aa, Bacteroides vulgatus
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEKKNDNVMIINSKVIDVVKAEKDKKYEKYWYNVLLENGLLYRAAFYNDISFWKGHTKEFVLKTIKLKSGGTKQELSFLPSFDEIEKMEKKQKDKMYFKIKLKTEADIDQAHKTVGTYIYDTLLGNPSQKIRGRLVRTIERKYYKEELKLILDKQKEFHPELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRLLMLARLEKCDISIEFLTKENEEALWHILYSVEDKNEIVKALQKFADKHDLNASFVDVFRKFPPFKKEYGSYSAKAIKKLLPLMRMGKYWSEDSIDKGTRKRMDKIITGEYDEKIENRVREKVIHLADVSDFRGLPLWLVCYIVYGRHSEAKEITQWKSPADIDSYLKSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRGKMKKLLMDDIPEEFVARQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKLLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 782 - protein, 1047 aa, Mannheimia sp. USDA-ARS-USMARC-1261
MKLLRYILGLDLGIASVGWAIVEIDENDFPIRLIDIGVRTFDKAEVSKTGESLALARRLARSTRRLIRRRAFRLLKGKRLLKQHNVINKEALTTLPTDCWALRVKGLDERLSPTEWSAVLLHLLKHRGYLSQRKNEAKSADKEMGALLSGVASNHQLLVENQFRTPAEIAVKKFALEEGHIRNQLGAYTHTFNRLDLLAEMKLLFQTQRELGNPHTSGQLEQEFCELLMWQKPALSGDAILKMLGKCTFETNEYKAAKHSYTAERFVWLTKLNNLRILEHGSERVLNTDERSLLLNQPYEKAKLTYTQVRKLLGLSEEARFNGVRYGKEKAEDATLIELKAYHAIRKAVEKADKSAWETLKNQTALLDEIGTTFSIYKTDDDITEQLNGKLSDTVLNALLENLNFDKFIQLSLKSLYNIVPLMEQGLRYDEACQQIYGDHFGKKSGEINRLLPPIPADEIRNPVVLRSLTQARKVINAVIRLYGSPARIHIETARELGKSYKDRKEIEKRQEQNRAEREKATAQFKTLFPTFIGEPKGKDILMMRLYEQQNGQCLYSGKPLNLNRLLEKGYVEIDHSLPFSRTWDDSQNNKVLVLAGENQNKGNQTPFEWLGKDEHQWALFVARVNGCRFPYAKKQRILTQKLDEQGFIERNLNDTRYIARFLVNFVRENLHLTGKGKNRVFASNGQITAFLRGRWGLSKVREESDRHHALDAVVVACSTVAMQQKITRFVKYQEGNLQTAERIDRETGEIIPLHFPDPWHFFRQEVMIRIFSENPQEDLIIQLPDRPEANHEFVQPLFVSRMPTRKMSGQGHMETIKSAKRLDEGISVSKVPLTQLKLKDLDNMVNREREKALYEALKARLNAFNDDPTKAFAEPFYKKGGQQVKAVRVEQVQKSGVVVRNGNGVADNASMVRVDVFIKGGKYFLVPIYTWQVAKGILPDRAVVAAKDESEWELMDKTAQFLFSMFPNDLIQVKTKKETFFGYYNGLDRATGAINLKEPDSNINKGKSGLHRSIGVKTALSVEKYQVDELGKNIRPCRPSKRQAVR

SEQ ID NO: 783 - protein, 1391 aa, Galbibacter marinus
MKTILGLDLGTNSIGWALVKEAENENEVSDIIKLGVRVNPLTVDELTNFEGGKAYSNNAERTLKRGARRNLQRYKLRRENLIEILLKNGLINKDTALTEVGKETTHQTLKLRSKSANEKVSLEDLAKILLSINKKRGYKSSRKVNAEDDGVAIDGMEVAKLLYDENMTPGEYVLRLLESGKKHLPDFYRSDLQEEFNLVWKKQSEFYPLILTKELFFELHGKNKSQTWAICKEPLGIVGVKLKGSAKEQKFARYRLRKEALTQQIELEHLAIVLQDINNDSNKSSGYLGAISDRSKELFFNKETVGQYQYKQLQKDPNTSLKNQVFYRQDYLDEFEVIWRNQAKFYPQLTNELKQEIRDVVIFYQRKLKSQKNLISFCQFESTQQNYVEKETGKTKIRTIGRRVIPRSSPLFQEFKIWQSLNNLKFVNSESNQIIQFIELEDDVKKVVFDELNLRGDLKPNQVLKILSKYMKIGKLTQWKCNLEEIEGNRTNSALYNVFQMIAEEEGYGFNWGKKSALEIKSELKAIFSSIGINDSILDFDFSKKLDQQLSYQLWHLLYSAEEGNSKITEEDKFTYGNTGVALKKKLHLKFGFKPEYSTLISNLRFTSDYGNLSSKAISKILPFLRDGSDYSKACQYAGYNHSNSLSADELDNRELKPKLELLKKNSLRNPVVEKILNQMVNVVNQVIDNYGKPDEVRIELARELKKSAKERSQMTKNISDATRRNAEIKKYLSKEFGIPNPTKGDVIRYRLWEELASNGYKDLFRDKYIPKEKLFSNEIDIEHIIPKALLFDDSFSNKTLAFKVDNLKKADRTAFDFMSTDFSKDVDSYIGRIETLHKDGKISSSKYKKLMIPKSKLVDGFIERDLRNTQYIAKQARKMLLEVFKTVVPTTGKITDKLREDWDLINVMKELNFPKYKALGLTKKIERFDVGSEKIKSINVIEGWSKRNDHRHHAMDALAVAFTTHNHIQYLNYLNARKDIHHEMHGTIKSIENQIIGKDVMGKRRFIPPISDLRMKAKLQIESILISFKNKNKVVTWSVNKTKLKGKDNYNKRRQLTPRGQLHKETVYGKIKLIDPKPLKLNNKFTLVRASMIVDKVHREIVLQHLSKYDNNSEVAFDSKTIKIDPILIEGIGLKEVVCYEDVFKIRKKISGDNFKNEKHLEKVIDEKVKQILKDRVIKFQGNFKEAFSNLEENPIWLNKSKGIAVKSVAIKGVNNAESLHEGKDHFGDQILDKNKKQIPVDFVSTGNNHHVGIYEDKDGNLQERVVSFFEAVTRVNEGLPIIDKTYNSDIGWKFKFTMKQNEMFVFPSDDFDPNEFDLTDGKNAAKISPNLYRVQKIATKNYMFRHHLETVVTNDLEFTYKSIRSTGWLRNLVKVRINHLGEIVYVGEY

SEQ ID NO: 784 - protein, 1337 aa, Fusobacterium necrophorum
MKKFENYYLGLDIGTSSIGWAVTNSQYDILKFNGKYMWGTRLFPEANTAQERRIHRSSRRRLKRRKERIQILQMLFDKEIAKIDSGFFQRLKDSKYYKEDKTEKQTNSIFHDKDYSDKEYHQDFPTIYHLRKFLLEGNKPKDIRFVYLALHHILTHRGHFLFPDMEVSNVTEFSNIFSELKQYLYDEMDLDFEWKNGKLNEVENILKDRNLAKSEKEKKLCGIIELEGKIDNQRKAMIGMMCGCKKKFSDLFQNENYRELEISSFSFADSSYEEKRDELEGILAENILCLDYLKTIYDWGKLSDILQGEESISVAKVKSYEEHQLDLKYLKNILKLYSHKEKENVFRKKEGKYPKYISGKLSQEEFNKSIKKILEEIKSVKQEDRKVFDTLLKRASNNLLCPKQVIKENGVIPYQIHKFELEKILRNMADFFPMLKEKKDGKTLSEKIISVFTFRIPYYVGPLNQNSDRAWLVKNKDEKIYPWNFEEIVNLEESAEKFIQNLTNKCTYLVLEDVLPKSSILYSKFMVLNELNNLKIDGEAISVDLKQKIYLNLFQKYKKVTLKKLKGYLKSENILIDTSTQITGIDGDFKSSLGSYLDFYNILGDKVKTDFGKKLIENCILWITLYTGEKKLLKNKIIANYKGELSEEEIKKIVNLKYKDWGRLSYAFLEEIQSASLETGELRNIIQMMWETNNNLMELLSSNYQFLSEIEKRNSVVAIGKEFNYETILGDSYASPSVKRMIWQSLSVVDEIKKIMKKAPKKIFIEMARQEDMKKERKESRKSTFLTLYKSIKEEGRDWIKEIENWSDSEFRSKKLYLYYTQMGKCMYTGEKISLDQLFNKNIYDIDHIYPRSKTKDDSIENIVLVKRNINAKKTDEYPLERNIQQKQHDFWKMLHSKKLIGDKKYERLTRTTEFTDEELSDFIARQLVETRQSTKIVADILKNLFPETKIVYVKANLTSDFRKNFKILKSRDINDYHHAHDAYLNIVTGNVYNIKFTDNPRNFIKDKKLEGKKYNLKVEKIFEYRKENESFWNPKTMVTKIENYIFKKRPQFTRYSFEQHGGFFDQNIVDKESCKKGTGYIPIKSSNAILYNTSKYGGYGSVTGTYFFLVEHTMKGKRIRTIEMMPLYLSKKIHSKEELEKYCKEKLELQKPSVRLARIKYNSLLKINGFPYHITGKTNDSYWIMSAIQLLLSKNYYEYLRKLYIFCKEERLEEEIVGEKNIKLYTCILEKLEKSIYSHKLLNINYNGKSKNLKDILESEKENFLLLSEKKQAQILIEIFTLLESNNFGANLESFGCGKKCGITKINKNIDKLEEVLLINQSPTGLFENSIDLKKV

SEQ ID NO: 785 - protein, 1262 aa, Treponema pedis
MKTLGLDIGTNSIGWGIVDEKAEKPIIDCGVYLFPEGVKIEKGVESSKAAERTGFRSARRLKFRRKLRKYETLKVLIQNGMCPLSSGELEVWRKEKIYPSSEAFVRWYRTSEAEQYEPYFLRKKCAEQKCTKHEIGRALYHIAQRRGFLSNRKETGKETEGGKVTDAIDELSKVMGEKTLGQYFYELRKTGDRVRGRYTGRKEHYEKEFYTICSVQGLSEELVKQLYRAIFYQRKLKSQKFLVGTCTFEPNKPRCPVSHFEFEEFRMLQFINSIKVAKNIDEDDRQDFVPLTQIEKEIIIPLFYRVSKTKVKFIDIEKKLRGKNKNESWKFNYRSDSNVAGCPVSAGLLHIFGENWKEIKIDNYDSYAIWHVLFDFDDRDKLREFAQTKLHLDDEEKVKSFLNIPIHQGYANLSLKAIKKILPFLREGMLYSHAVFMANIPAIIGQKAFEADKTKIIAGFENIIKAMPEKNREIALVNSCIDRIFKDKTRDFRSEQWNRAILEEQIADMYGKKYWEKKPQAEQQEIRRNAAEKIDDALRIAITNRANDYKYPLLRTDDLLKEYLREQGYTLHEKKELYHPSDIEYGFETPIAAEDGKMYLASPRTKSVKNPVAMRALFQLRKLINHLIKTGAIDSSTKVAVELANEVNDKNMRAAIARFQKENETKNAKYKQAIIETAAEHGFTIEPTDKDIKKYRLWKEQKEECPYTGKKISFTDLFGSMPQFDFEHTVPRSLSFDDSLENLTLCDVHFNRSVKKQQLPSQLAGKEDIIKRIKGYYGEKIDQCRAAIERNKPRGAYIEPSRKDAMIVNRHMAMYELHYYEQKLKRFTLEEIPSGFKNSQLNDTRLITKFALAYLKGVFSSVYPVNGFATDLFKRQWGLLERNEAKDRSYHRHHTIDALTIACINRGKYAALCEAVRNSADGRHLTFAKPWKSFDTDVLTATEYLVPKFYNDDNALRQTKKVIRDTRSGKPILKNGNKQYIQGHTARGSLHKDTFYGCIMTPPEKERKPENIFVERVSVSVLTEKDAEKIVDKGIRKIFIDNLESKIQTIEEIQTQGLLLPYKINGRTTYMKKVRIKVKTTKPLRIKKHPETENRKDYKNYFYAVNDENYLFVLYRGVSDDGKTVSDYRAVNLLDAVHAVQQKKEMYPAEMTKNGTVLKVYKTLKKGKTVILKESEEENIWELPHDAVWKRLYRIAALGVTGSGIQIRLVHCSCAETWVYLKGQGSVSEMMKFRCYNTPGSLVCLVEGCDFVISPDGKIIKK

SEQ ID NO: 786 - protein, 1483 aa, Prevotella sp. MSX73
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGTTLKTDKEGNVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQRWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIVEMNQNISKYNDGKPHQPILKVRITEPMGAKYRVGQTENKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGSECHFIPYYVANVIYNKVEFEAKNKIGRALTGEMIKAVCWKLEIDRLGNILKVIK

SEQ ID NO: 787 - protein, 1341 aa, Ruminococcus lactaris
MGKGYYVGLDMGTGSVGWAVTDESYQILRRHGKAMWGVRLFESAKTAEERRMFRTGRRRLDRRGWRIEILQEIFAEEISRVDPGFFLRMKESKYYPEDKRDIQGNCPELPYTLFVDKTFTDKDFHKKYPTIYHLRKMLMETEDTPDMRLVYLALHHMMKHRGHFLLSGDISQVTEFKNTFNQFIENIRNEEMDFEIELDESAVQMIEETLKDKNLTRSAKKSKLVKGLNAKNVRDKAFLTLLSGGTVKLSDLFGMEELNEGERPKISFADNGYEEYAAVVEMELGELYYIVESAKAVYDWAILSDILGGSTSVSDAKVRAYEKHKADLKYLKAVVKEYFPKEVYNAVFVESSDKLNNYPAYIGMTKKNGKKVSLEGKRCSREEFMDFLKKNIVVKLPDEEAKMYLQSELEKDSFLPKQVNKDNGVIPYQVHKYELKKILDNLGDKIPFLKENAEKIEKLFSFRIPYYVGPLRTGNGENSKFAWAERKSTEKIYPWNFENVIDVEQSAENFIRRMTNKCTYLIGEDVLPKDSLLYSKFMVLNELNNLRLDGQKISVELKQKIYRDVFCRSRKVTQKKLKSYLIREGIAGKNVELTGIDGDFKGSLTAYHDFKEKLIDVELTQKEKEEIILNIVLFGDDKKLLKQRLKKKFPQLTEKQINTVTALSYKGWGRLSKKLLEEVTVPAPETGEVWNIITALWETNDNFMQLLSKEYQFSDRIEEFNEEKADPEVSYQTIEDLYVSPAVKRQIWQTLQIIQEIEKVMGEKPKRVFVEMAREKQENKRTESRKKTLSDLYTKCKKEEPEWIEALCTSLEKHEEHQLRSDKLYLYYTQKGRCMYSGEPIDLEDLWDNTKYDIDHIYPQSKTMDDSLKNRVLVKKEYNAKKSDTYPIAADIQKKMMPFWKSLLTGGFIPKEKYDRLVRNNPLDANELAGFIERQIVETRQSTKAVAEILKKILPDTEIVYVKAKTVSKFRQDFDFIKVRDMNDLHHAKDAYLNIVVGNVYFVKFTKNAAWFVKENPGRTYNLEKMFIWDVARDGEIAWKAGKSGSIVQVRAMMEKNHILVTRRSYEVKGGLFDQQILKKGKGQVPVKESDERLRDIGKYGGYNKAAGVYFMLVSSKDKKGKEQRTIEFVPIYLKDRVEKDMESARNYLMEERGLREPKILIKKIKIDTLFKVDGFYMWLSGRTSNQLIFKGANQLILSKEDMKTLKKVVKYIQRQKEDKNVKISMRDGITEEELLKLYETFLDKIRHSIYGARLSSQEKTLVNGKEKFIDLSVEAKCQVLYEILHLFQCQSGAANLKMIGGPASAGILVMNNNISKCKNISIVNQSPTGIYEKEIDLLRV

SEQ ID NO: 788 - protein, 1195 aa, Candidatus Hepatoplasma crinochetorum Av
MQLENKKYLALDIGVTSLGWAISEYNNQKNNWNILDFGVRLWDAPEDSKSLDTKTSERRQFRSGRRLNSRKKIRINDLKKTFYNHKLLKKEDYQNHILKINKEGKKYFKDDKFNSIILRKKGLEEKLTNLELLIALINIAKRRGYSNRFLIPNLNENKDARKSIEKSKELIKKYKYPIKAITEDSFFNFNPKDLSKFNYRSRVFNESKFNEQIFLDKNKKEINIINLQNLLKKYNIDHKNESEKELINILKNTLIKKYNDNQILFNREDYENEFDALLNKQIEYNDKLSDIKEDLKKIIFRQRDFEDGPGPKDPEVKKIWKEKLNKDSKQFYYKQFFENLGNCEFFQDQKRLSCFSIENDISFILNETGKIFSKLKNEKQINSEKIKIITREIFDNYFKNLKFDRKIITEIFSKHNLNLPKLDGISFANSNLFLHSFAQNNENKEFILKNLKIDLNFLNTIRDSKINKIANVLFKNKTPEKLKNELIKIDSFFNDQNDGYNWIRKNNKWIGKGNKTLSTSSKFILSALKNQLDTGEIIFEYQNKIREKNTEEKLEKLKEKEIKLFSPIKDQDMQKNSVVFRAINQVRLVVRDLLKIHNFDGLIIEVAKDLYAEKTLRNKIRSNQDKNQKIREESENKLKEHNLIPTSKNINKYLIWKDQQLDQISKKENFAYDLYDVDFKEKIYLKNFIEDKNNEYQVDHIAPYSLVNDDTKNNKIVTSRKNNALKSNKTPLDFFKIQNFTNKQLNNWKNKIEKSINSNVKLAYLFMENLDRSKETGFESRNINDTRYITKYITDYLKLEFAKKERKENIKSPKILQIQGGITSYFRRLWLNPSNYKYGSLWGDINKPRDISPFHHAVDAIILSNMISEQHIEFYQLIVRIINFYNYYVNKKDSFNIKEKLFEQKRIIDNRFKDRGFVYFYGTKELNNKLNQVFNYLINLIDQKIKTNQRLERIDFTTDQNILNLISPLIENLPSKINNLIPVRLKQINQKYPATTFDSNTNEYIKEIKYKKIPAFLDTIEATEWANLNNKNIKDYPYVSYKIDKRIRGTLLAKQNPSSKKEAIDQKTGKLKNSFIKDKKGNFWDISKYIGYTYDQNKKLIPIYRNQIAEIAKQKEKINLILFKNAQFKLSNDEIIYTYKSLDSLEKRFSAPISNLTQHTNPKKYKEMFNIKLRISISKAQDLKLVNITRLGKIE

SEQ ID NO: 789 - protein, 1143 aa, Hyphomonas
MTAWRLGLDVGSNSIGWAAIELDANGRPCGILKGGNDKQFLPGAGARIFPDGRNPKDKQSLAAQRRVPRGMRRNRDRYLQRREDFLGALVGFGLMPADETERKTLENPTGRKRNQDIEIRKDFDPWCLRARALNETLTPFQIGRALFHLQQRRGFKSNRKADKEAKDGKISKGAVETLARMQERHARTLGELFGRPRLEGNLHASTRARLSGEGTKAFYDFYPTRDLILDEFEKIWQVQATYHPTILTREAYDKLYSILSFQRPLKPQPVGRCTLEPETDLRAPWALPSSQRRRLYETLNAMHYRKPGEAAEWLTSEQRDLLAEKALSKKDLTFDDMRKALKFHGDVKFSIESEKRKKIEGDHTAAILANKNLWGKEWRKLPFAEQEAIVELLLGLEPLTDKTPAQVRQVTEAVIEQAASTFSISRGETKTLLTSSDPAVLAHWLSERYGLSYEIAIDVVDANLPDSHQGLGRRANAKVLAELMADDAPVYSEAVVRSGYRDHRATEGQGEVHDRKLPYYGEVLERSVAFGTGDPRDSLEKRVGKIANPTVHVALNQLRKVVNRLMERYGPPSEVVIELARDLPLGAEDKRKLEREQQDNQNANEQREKILNEYGIRNTYVNRLKLRLFEELTRGKATNGQCLLSGEQFGLAKLLSDEIEIDHILPFAQTLDDGFNNKTLVTRRANRDKARRSPYEAFGTSPSGYDWEEIASRAADLPPQKSWRFSPDAMERYENEERDFLERQLNDTKYIARLTRTYLGAIYGGGDEAVKHVWVTPGRLTSDLRSVWGLNRILDGNKPSDEPDAPSRKNRDDHRHHAIDAIVVALTDRAMLKKAADHANLQNSEVSSERMLAALGEPWKGFREDVERHVNAIVVSHKKDHGIEGQLHEDTNYGVVQNPQGDGQKLATRKPIVSFEKHGQLQYIADNRIREELMERTYGLSGADFKQALHDYVNEQKPGRRTNPRRVRVHKPVTESTPLRQIHHGGIGEYQRGVLAGENYCLDIVETPDGKWHCREISRFDANRLKGSDKAEVPGWMEDNPEALLVMRLRKGDMIAVEDVPGEIEYKRVVRLEPSANRVRLARDREAGDYEKRHTDRDDLFSWDFATISKLKARKARLVHVDEAGRVFDPGLRHAGTDCRNIK

SEQ ID NO: 790 - protein, 1263 aa, Streptobacillus moniliformis
MKYILGLDLGVASIGWAVTEINEKGEPVGLIDANSVIFKPLDNDKGKLYNVERRDKRGSRRILRRKKHRVERTKMLLVNSSFLTNEEIDNLYVGKLDNIYEVRLKGLKEQLSKNEIARLMIYYCKNRGFKSNRKTEDLEILKSLGEKISEKDSDEKKLKPIIAKNTELIESKGLTPIEVIYMIRENDNSILGFKNKEGNYKFGFKRNQVIDEVRKILGTQQILSKEIVDEYIDILSSQRDFSDGPGGDSKYKIDYTKLAGKCKYTGEVRAVKSAPSYEIFTMLQKLNDIRYVKFTSEDKIEKKKLSKEVIHKLYDLVVEKNKTLTYDLIEKSIDEENIKLLNIPKLSKSKYVELRKSYFKERNDNENLTEEEINAFNEKLNNERMKQELIRNNLKAYKELKSKFKKNNIDENRIKELGGIYFLDLVAELLTYSKTDEKLEYFVENVERYSLFKEQRDIVEIIKTFPNYTKNGNLSLSLVRELNKLLMEGHDYESSLSSLNYYIDTDVDWEKFPTISEIEDSLSTKITNPNVKHILVILRKLYNTLLFKYGRPEKVHLELSRDFSNDFSTRNKIQKEQLENKVRREVAAFEMYGANKDIVAGKDRLSNDDFVRIKLWEEQNKVCMYSGRTIEKYQLTSAEVQIDHILPYSKSFDNSYSNKVLVFSNENQDKKERTPYQWLKGTEKWNEFKQRVRLNLNISNKKKENLLFEDEVVNNEFLERELHATSYSSRLALNIFQRLIPVSDEDKYDEHGNEKVKYLYNRNVIAFQGKMTSMLRNLYSLNKYTHSFESDTLDIDNKAFILKEFEINKDNLKMTAYNVNTGLEITSETKVEKNKSGEFKTIKDELLKKELDKKENLIEISDYFKDKVLFDLKIVDFEEIDTVEPEIISILYKMITALKEEVYSKNRENHLHHSLDAFLLTIMNRSMQMKLIKYNQLISVLKNKEIEIFNEEKGEYIDSKEFAEELQKQKIIDIDGNERGIKFNVNGKTHRLNLVKPYENFLDDIKNKIFDKRENNKLPYHVVKSKVSGALHAETILGESKGEITKRISVFDINYKNLGKIFDKDGSQKEIYETLVKWLEAKSKDYPKLKNGNIIKKVKIVDGNKDKLIKLGNKRYVEMGRTTVKILVLKKEAEEGLKFASIGRYKYNLLKSEKDVNISIWKDAIHFCKVRYNKLKENGYRLIHELIPGETIELELNKGNISKCLVVGFSGGKIEISSVIGDALDLINDKISTRIKERYYITVSTIKSIKKINKNILGDWYVI

SEQ ID NO: 791 - protein, 1392 aa, Gemella haemolysans
MANKTWYLGLDIGSASVGWAATDTGYKIIRKNKKRLWGVRLFEEAKTAEDRRGYRSSRRRLARRKWRLNLLEELFTSEVKKVDENFFLRLKESQYHYEDKTHKVPYAIFNDKDYTDKDYYKDYPTIYHLRSKLMTEENPDIRKVFLAIHHIIKNRGHFLLQGQSFKDGNLNNLIKELLELDILHVGFEVTEEVVDKIADISLEKKTSKDKLNDIKELYPKEKQLLEVFRLIFGGKTSLDKLFAIDEYKELDAAIKSVSFKEKIYEEVRHDYEQVLSNYIELLDLAKLVYDSIILSDIKKEGKTLSESKVELFEKHRDDLLKLKNLVKNDSKLSEDKKVELYALIFKEDKDKGTNYVNYIRKSEEGKGCNYEDFKKFLVKELAKLEESSVKTEIIKDLELEQFLPLQRTKDNSVVPYQIHKEELVKILDNAARYHSFLNEKDESGYNVREKVIQLLEFRIPYYVGPLNSSKKAKEGGFAWSVRNTGYENTPVTPWNYSKVIDESASAEKFITNLTNKCTYLKGEDVLPKSSLLYSEFALLNELNALKYDGNRISLEARNTIIEKLFKQQGKKVTKTSIKNLLKAEGYIDGKGEITGIDITVKNDLKSYRDFKKILGNKFNSEHVENIILWITLYGESRKLIKAKIESVYGEVYSKDEITKMSRLVYKDWGRFSRKLLTELVSKKLYNEETGECLNIIGAMRQNNILFMELLADRFDYSKQIVEFNKELQEDVTEIAPEILDDLYVSPAVKRSIWQTVRIVEELKKIIGCAPAKIFVETTRSNQEKKKPTDSRKKQLELAYKAVKKDVKELEKEIGTINFDVLNDRLSSVEPSKLKAKKLYLYYTQLGRCMYSEEPINISELFDNNKYDIDHIYPQSKIKDDSFTNTVLVKRESNAAKTDRYPLGSDIQTPSNRRFWKFLKEKGLISDEKYNRLVRTEEFSDEELSGFIARQLVETSQSVKAVASILGELNPETSICYSKAENVSSFRQNFGKIKKGDRDSKNNDQLIKVREINDYHHAKDAYLNVVVGNVYDTKFTRNVFNFIKDKKDGRKYSLNKVFYENVSDSKTVAWEMDKTIHQVEKVMNNNNIMVTRRTSEQKGGLFDATVYKAKVAAKAKDGVYYPLKTSNSVVKDVAKYGGYTSIGIAYYSIFEYTIVNKKGEEKITRIIPIPIYISQNIKDSTALIEFGKSQIFCRAYEKIKDFKLLYRKLCIGSKININNYQYYIGGKSDERFYYDSAIQVTLDKKSEKYLKILSKYQNWKKENKDGELWENITKENNIELYNKLVEKMNSEIFTKKKSNKYNELNSEEIRNNFIKISVEEQAKVLLEILNLLTNKKSIFDLKSIDIKAARGKISFNLTSLIQFSIIEQSITGFYEKEITIIGDKGNDMENNNS

SEQ ID NO: 792 - protein, 1077 aa, Neisseria bacilliformis
MQQKPQRYILGLDLGIASVGWACVWADENEHPTGLLDCGVRTFERAEVPKTGDSLALARRQARSVRRLIRRRAHRLLRLRRLLKREGVLLSADFNENGLVRGLPIDAWALRVAGLDRKLSNKEWAAVLLHLVKHRGYLSQRKNETQSKDKELGRLLAGVNGNREALQNRSDEYRTAAELAVKKFAAENNGSLRNKGGDYSHTFDRKDLQRELHLLFERQRALDNPFTSSEMEAAVDELLMKQRSALQGEAVLKMLGRCTFEPSEYKAAKNTYSAERFVWLTKLNNLRIQYNGEERALSEAERRLLLDEPYQKAKLTYKQVRTILELPESAVFKGLRYGHGEDGLKAESGTLMEMKAYHAVRKALKDAGLEGEWENRIRNPELLDAIGTAFSLYKTDEDIRANLAAFRLSENVLEALLAGLNFDKFVHLSLKALAKILPLMEQGMRYDEACKEAYGDHYGAKEQEDHRLLPPFVADDIRNPVVFRTLTQARKIVNEIVRRYGSPLRVHIETGREVGKSFSDRKEIEKRQEENRKERERAAAHFKELFPNFAGEPKAQDILKLRLYEQQHGKCLYSGKEIDLRRLPEKGYVEIDHALPFSRTWDDSFNNKVLVLGKENQDKRNRTPYEYLDGKGNSGAWRAFAERVSGCRFPYAKKQRLLTQKLDEKTEQGFLERNLNDTRYVARFLCQFIEEKMHLEGAGKKRVFASNGQITALLRGFWGLKKVREENDRHHALDAVVVACSSVSMQQKITRHFRYREELEHIDRETGEVIHGFPQPWEFFRQEVMTRVFSDDPVSELAEKLDSRPEAVHEFVTPLFVSRAPHRKVTGQGHLETIRSAKRLDEKISVVKLPLTQLKTKDIERIVGYPNREPALYDALAARLAAFKDDPAKAFSEPFYKTGKDGKCGVLVKAVRVENVQKSGLLVRKDESGKMQGVADNATMVRVDVFGKNGKNYLVPVYAWQVEKGELPNRAVVAYADEEDWDEMDDSFEFKFSLYPNDLVEVVTKKDKFFGYYSGFNRATGAINIKEHDLSKSKVKNGVYEGIGVKTAQSFQKYQVDTLGKTIRLCKPEKRMGFKKK

SEQ ID NO: 793 - protein, 1155 aa, Streptococcus dysgalactiae
MDKKYSIGLDIGTNSVGWAVITDDYKVPSKKFKVLGNTDRHSIKKNLIGALLFDSGETAEATRLKRSARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNRRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKYQSYKMEK

SEQ ID NO: 794 - protein, 1015 aa, Helicobacter canadensis
MQNKKGLIMKVLGFDIGINSIGWAFVENNELKDCGVRLFTKAENPKTKESLALPRRNARSSRVRLRRRRSRLLSLKHIISKEFGLHYEDYIALDGNLPKAYTGKIESIYKLRYEALSQAISKEDLARVILHIAKHRGYMNKNQKTSQDSEKGAILSAIKENSNKIKHYQTAGEYFYKELFENLRDGTKEFKNIRNKAMKNEKTGNMESTYYNTILASDLEKELKLILEKQQAYHNYSDTFIKEVLEIAFYQRPLKDFSHLVGSCTFYENEKRACKNSYSAWEFIALGKIINTLESIKKDTGEIFSNEIITQILKEVLDKGSLSYTKLRKMINLDEKVKFKGLKYDKEGVEKTNLIEFKKLKEFKKALGEHNLERKTLDEIATHITLTKDENQLKKQLEQYALSQNQIDALAELDFNDHINLSFKALYEILPLMEKGKRYDEACNELGLKAKTSNQKSEFLPAFCDSIFAQELTNPIVNRAISEYRKVLNRLLKKYGKMHKIHIELARDAGLSKEARNKIEKEQKENKDINDKAEKTCKEFGLKPNAKNILKIKLWREQGEICAYSGKKITIDDLKEDKALEVDHIYPYSRSYDDSYNNKVLVFIKENQLKLNQTPYEAFGSNQEKWSKIQVLAQKLPYKKKNRILDENFKNKDQIEFISRNLNDTRYATSLIAKYTKEYLEFLPLSDDEDISLKSGEKGSKTHVQTMNGMLTSVLRHAWGFSQKDRNNHLHHALDAIIIAYSTNSIIKAFSDFKKNQEILKAKLYAKKLTSEEYKNQSKFTGFEKYRSKILEKLDSIFVSKPPNKNTKGALHEQTFYSYQDILEEYKTQEGLKRALECGKVRKIGTKYVVNDRMVRLDIFKKDNKFYGIPIYTMDFALGVLPNKVVTIGTDKDKIKKEWKTIDETYEFCFSLYKGDLVLIQKKEMQESEFAYYNGFDISSASISLEKHDNKFENLTENQKLLFPKAKEGDVEVRGIGIQGLKVFKKYMVTPLGEIQETRTEARQNIQPRKKHGLR

SEQ ID NO: 795 - protein, 1345 aa, Listeria monocytogenes Lm_1880
MQLKIVEGMKKMKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 796 - protein, 1389 aa, Oenococcus kitaharae DSM 17330
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 797 - protein, 1149 aa, Spiroplasma apis?
MKKYILGLDLGISSVGWAVTGYDDENAIEPWLDDFGVRLFEVPENPKDKTSLAAERRGFRSSRRLKRRKKARIKLLKKILIDSDIINENLYEKTFNFSISSLKPTNKIVYDEKKYFNPYVIRKKGLKEKLSSEELTIALVHIAKNRGFENLFDPEKGEDKSELKDDAEINEKEDYANSIIIARKLIGYDIATKTCKKTIAEAFIDEESSTRIEKNKNLLNVRNKDSQYRFLFPRAAYKYELELILNKQAEYYPQLNNEIIDKIMDTILRQRFFEDGFGPKNISRAENIELIKQKLSNIKDKNNHYIALRDSLRAYKLYKPFTELVGNCTFFPNEKRYIKSSIIFDLYQMAVEVSKFSSFLENKQTIKDFHNKLFNLALTDEKFISNNKKQIESVLKTDFGVKSEDLKNLKALDNAKKTDLFGFTKRFIKVFGMEKLKELNIDNLDSNIIDDLGDILNKNITPELRKSNIKKWASDNNVTINDENINQLLLTPSKVTTTSNLCKKAMLMVIKHFLEGEIAGVYQDELKAKANEYTDLNIKKFLQPIVDGDLVRNPVVFRAINEARKVLKALFRKYNDFEKINVETSRELGKSGEVRNELNKKNLDSRAKNEVIKSELEKIGIVANTTSILKYKLWLAQDKKCLYSLRDIKIEQLNSHELEVDHILPISKFPDDSFDNKVLVYTTENQLKKNRTPLEYFNAENPDIINSYKKNCLDLYRKGNITWNKYENLLIKSVLDIDQNKFSSRNLVDNSYIARYFANWLKNNLIHKYKKENKEYKSNVLMIKGVVTSRFRRKWLRFSPWGLDIKVRDITPFHHAVDAIVLSQFKNQGSVDFASDLIAIENEFKSFKYKNISLEQYHNNVKEICSKWHDNSGYQWQFQISKPIERIDDFINSDCQAIKMFPLVKNLDKLIDLRMPIELSVKVDVDTVKLTEKELKRNFKNLNELSILNEKDFKKEIKVKRPVFVKVKHPQEYIETLKNANVAGDIHYPFVSYKVNHKVSGSVTSSEKMAAKKLLKDSNKDQFHIDRHGNLWETNVYYGVIIDKEGINKPRWIKKIDIFKNKNILKLRDNELILRQNDTVFYKNKDDNYEYKVFKSKMGAQICATKINTTYISTLHKNKEIFGTQNCYDSLSNILKEIKIITIDILGKA

SEQ ID NO: 798 - protein, 1137 aa, Bifidobacterium callitrichos
MSAKRYRVGIDVGLNSVGLAAIEVDDANTPIRILNAQSVIHDGGVDPTRNKDAATRKSVSGESRRARRMLRRRRKRLNQLDELLQRLGYPIIDPETLDTFDEWKIRSGLADVFIEDEATRKENISIAIRHIARHRGWRNPYHRVESLLVDNPYSEQYRELKTRAEAQIGHALDEDMTSAQIVIAAWPHRTVDNARLRTSSKRGEGLLPSKLMQEDNANELKRIFSVQRVPESEGDLLFHAIFRANSPKGSAEKRVGRDPFDAAQPRALKASLVFQRYRIANVLTNLRIQENKQERPLTIEEKQTIFAMLVSDDSKDITWGDVASHLGYERRQLRGVGKTTEDGEDRISSTPPRLTSFQRICEADKKIAKPLQAWWQNASGQAQESMIRLLSNTVDLDGVHGDISYEEALDFIDGLDDEGLSRLDSVDLPAGRAAYGEETLRKLTERMLTTNDDLHAARKVLFHVSDYWRPPADPIGASLGNPSVDRVLRIVSRWLSNCRNRWGTPVSVQIEHVRSAFDSVATARQYERRTGNRSVYRSSLAKQLRESEHLDRVRSEDIRRIEAIQRQNGECLYCGRPIAFRNCEMDHIVPRKGAGSTNTRTNLAAVCIECNRLKSNIPFAVWADSEAAHARGVNLKESLQRVDHMLYDRNADTSQTWRRFKQDVKIRLKQTYSDEPIDNRSIESVAWMADELHRRIDWYFNAGHYLEECDELRPRIMVEVRVFQGRVTALARRASGLEGRIHFFGARYKTRLDRRHHAMDASVIAIMRPSVAQTLVERDSLRESQLIAGRLANGERSWKEYPYEGCPGYVPFQQWRAAMESLLELLNDALDHDRIVVRQPMRLQLGNSIAHDATVKKLLRVRLGDAMDADLVRRASTPALWCALTRLPDFDAAVGLPANDSRTIAVHGVTYSASDEVEFFDGQSAQLAVRGGSADIGSSIHHARVYRCWKQNAKGVRKYWYGMIRVFQVDLLRARGADLFSEPLPPQSVSMRWGEPRTVQAVQAGNATYLGWMVVGDELRVEFPRETALNGQIGEFVDWCDGSDSASTAQCSWVLDGFFSNKQLRLHPRLLASEGLMKLGKNQEIPDGVQKVVAKTGWISTVDVFGGFSPTVIRRNTLGEARWRSQSGLPCSWRWFD

SEQ ID NO: 799 - protein, 1377 aa, Streptococcus sp. C300
MNNKPYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLEEKAPLQFSKDTYDEDLENLLEQIGDDFADLFVAAKKLYDAILLSGILTVTDPSTKAPLSASMIERYENHQKDLAVLKQFIKTNLPEKYVEVFSDQSKDGYAGYIDGKTTQEAFYKYIKNLLSKFDGADYFLDKIEREVFLRKQRTFDNGSIPHQIHLQEMNTILRRQGEHYPFLKENKEKIEKILTFRIPYHVGPLARGNRDFAWLTRNSDQAIRPWNFEEIVDKASSAEDFINKMTNYDLYLPEEKVLPKHSLLYETFAVYNELTKVKFIAEGMRDYQFLDSGQKKKIINQLFKKKRKVTEDDIIDCLQKIDNYDGIELKGIEKQFNASLSTYHDILKIIRDKEFMDDPKNGDILENVIHTLTIFEDREMIKQRLAQYNSIFDEKVIKALSRKHYTGWGKLSAKLIDGIRDKQTGKTILDYLMDDGKSNRNFMQLIKDDELSFTEIIQKAQVVGDTDNLRQVVQNLPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALNINQLSSYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLIPIKSGLSPEKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 800 - protein, 1117 aa, Burkholderiales bacterium GJ-E10
MQTKNLLYTLGLDIGIASVGWCVLGENRIIDLGVRCFDKAETPDRGESLNKVRRDARLMRRRLRRRAWRLTKLARLLKHAGLIDSTRIVRDRHDGAVSPWQLRVEGLDRKLAPEEWARVIYHIVKHRGFHWISRAEERKAESDKGEGGKVKQGLSATKQLMVEKNYRSAAEMVLTEFPGAQRNKRGEYTKALSRILLAAELTTLFERQQELGNPHAGPDLQTKILGNGDRKSGLLWMQKPPLSGSALLKMLGKCTFEREEYRAPKASFTAERHVWLTKLNNLRVLVDGVTRPLSDPERRLALSLPYQQASDFTYKQLRAALCKNGLLPDSFQFSGLAYPTGAQQPDGKAKNPENDRLVKLPAWQEFRKTLRDAGLETEWESIAGMAAGGQPDLLDQIGWVLSVFKDGDEVLRELRKIPLPGGEKMVQALSGVSFDTFHNLSLKALRKIVPHMEAGLRYDEACLAAGYHHSDLRKDTDERSLYLPPLYSGRTTDGRMVFRDDIDVPRNPVVLRAINQARTVVNSVVRRYGSPSSMHIEMARDLSRPWDERNKVKRAQEEYRDRNEKLKIDFAAEYGIEPKSREFEKFLLYREQGGKCAYSLKPLDLDRVLRDLGYAEVDHALPYSRSFDDSKNNKVLVLAEENRNKGNRTPYEYLDGTSESPRWREFKAFVETNKAYRLAKRARLLRKDFSGKGSEEFRDRNLNDTRYISRFFKNYVERFLKLAEESEERTCVVLSGQLTAFLRARWGLAKVRGDSDRHHALDAAVIAACSRSMVKRLSDYARRHELEKVRTGFVDFETGEIVDAGKYRQIERDFPSPWPYFRDELLTRLNTDDPAELRERMQSLGSYPPEALETLRPMFVSRAPQRRNGGAAHKDTIYRQTERLKKVGSVTQKVPLAALNLRDLENLVDPHRNEKLYAAIRARLEAHGGKGEKAFPPNNPLRKPDRDGNPTGPIVRTVTLVIDKMSGIPVRGGVAKNDTMLRVDIFRSKKDGKFHLVPLYVHHAVAKQLPTRAVIAYKDEGEWTPINNHDFDFLFALYPNDLVRITLKKERHFGYYAGCNRATGAVSIWAHDRNQRIGKDGFIDGIGVKTALSVEKFHVDTLGNVYPAPPETRRGLA

SEQ ID NO: 801 - protein, 1377 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 802 - protein, 1065 aa, Actinobacillus succinogenes
MNNMNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 803 - protein, 1368 aa, Lactobacillus reuteri
MIKKDYNIGLDIGATSVGFAGIDEQYDPIKLKGKTVVGVNLFEEGQTAADRRSFRTTRRRLNRRKWRLSLLEEFFDPYITPVDPAFFARLKESNLSPKDNNKNFSRSLLFPDITDQKFYEEYPTIYHLRYALMTENKKFDLRAIFLAIHHMIKYRGNFLNSTPVAHFDTSKIDFANDFSKLNRLYLNEDPNNIFEINLQNVKEISDILLDHSIKKFDKQKQVAKLLLTSQNDKELDKRNKQIATQISKAILGYNFSLNEILKLEAVNKSKWKLNFSSADIDDTLPDLISELDESQESILNIILSLYSRLTLNGIVPSGMSLSESMIDKYGTHKEHLDLLKKYLKTLPIKNRKEIAEAYAEYVGNSLKKSGHISQEEFYKAVKKNLDKSETAQKILSLISEEKFMPKQRTNQNGVIPYQLHQKELDQIIVNQSQYYPWLAELNPVTEHKDAKYKLDELIAFRVPYYVGPLIDPKTIPQTEQGNKNASFAWMVRKENGQITPWNFDKKVDRISSANNFIKRMTTKDTYLIGEDVLPAHSLIYERFKVLNELNMIRVNGKKLSVSVKQNLYNDLFKQQKTINRKKLANYLQANLGIPERPQITGLSDPEKFNSQLSSYIDLQKILGSEIVDDPNKQDDLEKIIEWSTVFEDSRIYKVKLQEIGWFTEKQKNELVSHRYQGWGRLSKKLLVELKDKNGRSIIDLLWNSQRTFMEIQSRPEFAEQITNENQDKLTEDNYEDVLADAYTSPQNKKAIRQVIKVVDDIVKATGKAPKFISLEFARSDERSDRVKSRKTHIQKIYETTAKELLKDDQLIKELGSVSDLSDRLYLYFTQLGRDMYTGKPINIDEISTMYDIDHILPQAFLKDDSLDNRVLVRRQDNNAKSDTVPALKFGKMKPFWNKLQKHGLISKRKLNNLQTNPESIDKFKAVGFVNRQLVETRQVIKLAANILASRYPDSKIIEVKASLTHQMRESFNLIKNRDVNDYHHAVDAYLSAFVGQYLYNRYPKLQPYFVYGQFKKFDKQSTRIGMKTNHFNFLYDLEPEGKNVKIKKPTKIINKETGEIIGDRDELVAKLNRVYNFKYMLVSQEVYTRSGALFDQTIYPANSGKKLIPLKQNKTTAIYGGYSGSKAAYMSIIRLRDKKGGTYRIVGIPVRAVNKLNQAKKKSNEKYLAELKAVIEPQIAKTKKDRKTGQRVLVPQEFDVIIPEVMYRQLIVDGDQKFTLGGTIDRYNAVQLVLNQEILTFLEQPTKYKDADTKLLDIYDQIVNLVEKYFMLFDSKRLAAGRVAFEKLPTLQPVDKMPSKLIIIRRIIQGLHDNAARTDLKAINGSSSFGRLQKRNGIILSPNACLIYQSPTGLFERKVYLNTISPLK

SEQ ID NO: 804 - protein, 1248 aa, Sediminibacterium sp. C3
MNKKILGLDLGVTSIGWAVIQENDSRKEILGMGSRIVPLDNDEKTEFSTGNKISKNQKRTAKRTQRKGYDRYQLRRSYLTKVLIENKMFDESLFKLPSIELWGLRAKGVTEKLSLKEIGRVLYHLNQKRGYKSSRSDANLDKKDTEYVLAVKGRHQEIKELGLTIGQKFYKELQQNEFYRIKEQVFPREAYLEEFDAIVKIQSGFYPEIFTEQLISKIRNEIIYYQRPLKSQKGLVSICELAGFTTKDGKGNSIFVGPKVAPKSSPIFQLCKIWEIVNNISLKIKSQESKGNKWIDFVPTIEQKERIVNYLNNNTKLSYTELIKILGLNKENVYANKQIQNGLPGNITVAEIKKVLENDIPDFDIEILLLDSIQVLVDKKSGEILSEVSGEVISENFENNTLYRIWHTIYSIKDEVECQLALVQKFGISEQKAKALAKIDFTKHGFGNKSSKAIRKILPYLMRGYVYSDACELAGFNHSNSLTKEEKAKMEYAEKLELIPKNSLRQPVVEKILNQAINVVNAIISKYGKPDEIRVELARELKQSKDERNEMDFRNRSNEKLNAEIGQRLSSLGIPATKRYIQKYKFIFPSLSKNLKDAHVENICIYCGKSFNISEALTGDNFDVDHIVPKSLLFDDSQTNKVLVHRSCNAQKTNQTAFDFIAKKGDVELTDYISRVDDWFKRGIISYSKMQRLKISYEGYLERKRQKKETESDKKIWENFIDRQLRETQYISRKARSIFEKICPLVTTSEGTVTAELRRLWGWNDVLMNLQKPKYQALGLTQKIEWSSNHGQKQHSKEEIIGWTKRDDHRHHAVDALVVACTKQGYIQRINTLNSSDVKDAMRREILDASIVFDEKRNLLEQYFIKERPFTTSEVENEAAKILVSFKSGKKVASKGIRKAKINGEKQIVQRNIIVPRGALSEESVYGKIKIIEKGKPVKYLFEHPDLIVNTDIKNLIRERLNQNEGNVRLALASIKKNELLTQSGVKILEGDCYKEEYVIKYPIQNIKSKDVEFIVDGAVKNAIQKRLDKYGGKEKEAFKETVWLNEEKQIPIKTVRMFTGLSVVEPFSKDNRGHAIGFVKPGNNHHIAIYIDENGNKLEHICTFWHAVERKKYGLPVIIKDTNEVWSKILEGNDYPDSFLEKLPKDKLIYHESMQQNEYFLLGIDESVLSDLENIDYSFLSDYLYRVQKIGASYYVFRHHLETSLVDTNEAKLSKRYISIRSFAAYDSYKPIKVWVDVIGKIRKINA

SEQ ID NO: 805 - protein, 1526 aa, Bacteroides timonensis
MKKILGLDLGTNSIGWALIDGEENRILGMGSRIIPMTQDVLDTFSGGNPLETQTAVRTAYRGVRRLRERTLLRRERLLRVLNVMAFLPEHYAFQIDFEKRLGQFLDEKEPKLAWRQNDDGKFEFIFQQSFNEMIEEFKNNGVVAGDKKIPYDWTIYYLRKKALSQKIEKEELAWILLNFNQKRGYYQLRGEEEEENSNKSVEYYSLKIADVVADDRSNSKGETWYSLHLENGWVYRRSSRIPLFDWKDKTRDFIVTTDLNDDGTVKKDKEGIEKRSFRAPSENDWTLLKKKTEKDIEKSRKTVGAYIYETLLQNPMQKVRGKLVRTVERKFYKDELRQILEKQKEFHSELGNEDLYNDCIRELYRNNETYQLILSKRDFVHLLLNDILFYQRPLRSQKSSISDCALEFQTYKDKDGNEIKEHLKAASKSNPLYQEFRIWQWLYNLRIYRKEDGEDVTAQFITGVEDKEQLFDFLNDRRDVEQKPLLDYLIKAKGLKKQVKTDTYRWNYVEDKAYPCNETGVMISTRLAKVENISDDFLTKEMEQKLWHIIYSVTDKNEFEKALKTFAKKNGLDVVSFVDSFKKFPPFKCEYGAFSEKAIKKLLPLMRLGKYWKWNDIDDNTQNRISKIITGEYDEGIKDIVREKVVNLTNENDFQGLQLWLTQYVVYGRHSEADIAGKWRSVADLEKYLDDFKQHSLRNPIVEQVITETLRVVRDIWKQYGRGAEDFFSEIHVELGRDMKNTADERKRLTNVIVENENTNLRIKALLMELKNNADGKLEIENVRPYSPMQQDILKIYEEGVINSGIEIDEDIRKISKTAQPTAAELQRYRLWLEQKYRSPYTGKVIPLGKLFTEEYQIEHIIPKSRYYDDSLSNKVICEAAVNKLKDKYLGFEFIKNYHGQIVEIGFGQKATIFDEGEYQDFVKRHYAHNHSKRAKLLLEEIPEKMIERQMNDTRYISKFVFPLLSNLVRAEKGDDGVNSKNVLPGNGKITTILKQDWGLNDVWNDLILPRFVRMNKLTGTTAFTSWNEQYQKYLPTVPLDLSKGFQKKRIDHRHHAMDALVIACATRDHINLLNNKHANTDTIRYDLQRKLRLFERVTYTDPHTKEQVTKDIPKEFKKPWDSFTVDARNELGKIVVSFKQNLRIINKATNIYEKYEDGEKVNVKQKGINWAIRKPLHKETVFAKVSLRKIKKVRLSDALKDWKKIVDKGLKQEIERLVCQYHRFNPDEICRYFKARGNQFGGVDISKVDVYYFDEENAAVRKNVDTSFTEKFIRESVTDTGIQKILINHLKAKGDKTEIAFSPEGIEEMNKNIVQLNGGKFHQPILKVRIYQALGNKFQIGTMGNKKDKYVVAEAGTNLFFVVYEKDGKRNYETIPLNEVIEHQKWRGTLSKEEQQKIPVIPIKNDRGMFVFYLSPNDLVYVPTAEQLGDINISVNDIKPNRIYRFTDSSDTRANFIPMSIAEVLFNCNKDKQKKIGIEYSIQNEIGIGSQGSKNQKSINGDMIKDICLKLKIDRLGSIKEISGL

SEQ ID NO: 806 - protein, 1077 aa, Oceanobacillus manasiensis
MKYSIGLDIGISSVGWAVINLDKERIEDLNSRMFDVAENPKNGSSLATPRREARSARKRLRRRRYRVGRIRNLIIKKGLLSEVEADHLYEWQDGDFDIWLIRVNGLERKLTEREFARILIHYAKNRGFKSNRKSETNESEGGVLLKAVRENALLMEEKGYRSVAEMLVLDEKFNGKKRNKGGDYSHVLARDEIEKEIKDVFENQRKYGNEFATINIEKEYIDIWSSQRPFSSQDDIAKKIGNCTLEEDQKRAPKFSYTFEKFRGLDKINRLRIISTEGPQRSLTGKERQEVMNSMLTKKEIKYKDLRKVLQLKDCERFNELYYDPGDTNEKNENKIFISLAGYYALKKIVKEVEGKTLAESYRPIDYDTFAYAVTVYKDDHDARDYLSNEYVNKNGKRVSNLANRHYSSELIEALLNLSYSKFGHLSLKALNKIIPFLEEGLLYNQACEKAGYNFNQKVGDKKEKFLPVIPADDIANPVVIRALSQTRKVINAIIKRYGSPSSIYIELARDMGRHYKERKEIEKQYNNNWKLNEKAKNQIHELHPEISNPRGHDILKYKLWEEQDGRCAYSLRPISQEKLFDYGTAEVDHIIPYSRSFDDSNANKVLVLARENQNKQNRTPYEWFGNDEVRWDKYISYVNSLKVRKKKKDLLLKQNFDDEQAEQFKSRHLNDTRYITRFLKAFIDDNLQFRGEEGNKQYVYTVNGAYTSLMRKRWGFNKNRSENDLHHALDAVLVAVSLPFRHRVSNYFKHSELHSSQILKRKGERFPEPWEGFSKELEARMLQNPEKLKLALESLSLASYDGDFLNRVKPIFVSRMPKRSVKGQIHEETIRRHRGFTEKGLNLMVKKYALKDINFDKNGDFPMYGKESDPKTYAAIKERYLEYGKDAGKAFSTVLYKPSKNPENAPIIRSVKLETTANQVFHLNDKTVAENASIARTEVFRHKENGRYYLAPVYVSDVLKNRVPEKFITALKPYSEWEEITSDYEFLFSLFSNDIIKLKMPREKKSKLNTGDLVTWDEGMFYFKGVHTGTAQINIIDHMSSFKDAIGSKSLQSFVKYQTDPLGNLTQVQKEKRYGV

SEQ ID NO: 807 - protein, 1122 aa, Comamonas granuli
MTQYVFGLDIGIASVGWAVLGDTRIVDVGVRCFDKAETAKEGDPLNLARRQARLLRRRLYRRAWRLTQLARLLKREGLIDNAKLFAQSPSFTDSAWELRRQGLDRLLTPLEWARVIYHLCKHRGFHWMSKAEEAKADSDAEGGRVKKGLKDTAARMAEKGYRSAAEMVLAEFPSAQRNKHGQYDKALSRMLLGEELALLFATQRRLGNPHASEHFETQILGNGDRRSGLFWQQKPALAGADLLKMLGKCTFEKNEFRAPKASFSAERHTWLTRLNNLRVIENGRSRPLNDAERTAALLLPYQTESFKYATLKKAFIKKGLWSDEMRFGGLAYPSRAQAESDKAKDPEDQFLVKLPTWHELRKAFNKVGQEALWQRISTPALDGRPELLDQIAWVLSVYKDGAEIEQQLRLLALPEPDICIPILEKISFDKFSSLSFKALRRIVPLMQTGLRYDEAVAQIPEYGHHSQRIDPDAPKRLHLPPFYQDQRKYSGKNDHVGSMQFREDANVPRNPVVLRALNQARKVVNALIRRYGSPIAVHIEMARDLSRPLDERNKVKKAQEEFRDRNDKARTDFERDFGYKPKAAAFEKWMLYREQFGQCAYSQEPLDIQRVLDDPNYAQVDHALPYSRSYDDGKNNKVLVLTRQNQNKGNRTPYEYLTALDGGQEGERWRAFSAWVQGNKSYRMAKRNRLLRKSYGAEESKGFIDRNLNDTRYICKFFKNYVEEHLQLAERADGETTRRCVVVNGQLTAFLRARWGLAKVRGDSDRHHALDATVVAACTHGMVKRLADYSRRKELELLQEGFPDPETGDIINPAAFDRVRQHFPEPWAHFRHEVQARLFTDDLTKLREDMQRLGTYTAEDLTALRTLFVSRAPQRRNGGAVHKDTIYAQPESLKVQGGVIEKVQLTSLTLKDLDNLVEPHRNERLYAAIRTRLEDHGGKADKAFGPDNPLHKPDKNGQPTGPVVRSVKLVRNKQSGIPIRGGLAKNDSMLRVDVFTKAGKFHLVPVYVHHRVTGLPNRAIVAFKNEDEWTQIDDSFAFLFSIYPNDFLRVTLKKERFDGYYSSTDRSTGAVTLWAHDRAASVGKDGLIRGIGVKTALSIEKFNVDVLGHIYPAPLEVRRGLA

SEQ ID NO: 808 - protein, 1104 aa, bacterium LF-3
MSRYVLGLDIGITSVGYGVIDIDNNLFVDYGVRLFKEGTAAENETRRTKRGSRRLKRRKSNRLNDMKNLLKENDLYFEDYRNYNPYEIRAKGLKEKLLPEELCTAIMHITKSRGTTLEALADESQDDEGTKATLSKNAKELNDGKYICEVQLDRLNKDHKVRGTENNFKTEDYVKELKEILKHQDLNEELCDQIIEMVSRRRRYDQGPGSEKSPTPYGSYRMVDGVLKHVNLIDEMRGRCSVYPDEFRAPKQSYTAELFNLLNDLNNLTIKGEKITVEEKEKVVAFVNEKGSITVKQLLKLLDAQEDEVTGFRIDKNDKPLITEFKGYSKVLKVFKKYNQQELLEDKLIVDQVIDICTKSKGIDERKKDIKELYPEFDNELIEELASVKGVSAYHSLSFKAMHIINKEMLTTEMNQIQVLHEIEMFDKNRKSLKGKKNIEPDEEAILSPVAKRAHRETFKVINALRKQYGEFDSIVIEMTRDKNSKEQVKRINDSQKRFKSENDRVDGIIKNSGIDPERVNGKTKTKIRLYLQQDCKTAYTQQDIDLHTLIFDDKAYEIDHIIPISVSLDDSLTNKVLASRLENQQKGNLTPMMAYLKGKFTGGNLEKYKLFVSSNKNFNGKKRNNLLTEQDITKEDVARKFINRNLVDTSYACRTVLNTLQRYFKDNEIDTKVHTIRGQSTNIFRKRINLQKDREQDYFHHAIDALIVASLKKMNIVNSYLMHYNYSDLYDEETGEVFDVLPDKQFIDQRYISFISDLKNIYQESNQYNLGYITQEQMHYPLIKVSHKIDTKPNRKIADETIYSTRNIEGQDMLVEKIKNIYDPKEKKAIELVNNIINDDTDKYIMKHKDPQTFEKIKEVVLNHFNDYKDSKEYYVIDKKGKYSLKEESPLTSYYNENGAITKYSKKNNGPAITSMKFYSEKLGNHLAITSNYNTNNKKVILKQISPYRTDFYVSPEGKYKFVTVRYKDVFYKETIHKFVIDENWYHEEKIKKGILEDWKFVCSMHRDELIGLIKPEGKKFVYDASINGGQTQYHDGKHYEILKFTATNDEKKRTFEVKPINTNCSKRLMPSVGPFIKIQKFATDVLGNIYEVKDNRLKLEFD

SEQ ID NO: 809 - protein, 1403 aa, Weeksella massiliensis
MKTILGLDLGTNSIGWAYVKEAENNLEMSSIEKIGVRVNPLTTDEQTNFEKGKPITTNAGRTLARSARRNLQRFKLRRENLIQILKTHQWISDETILAEDGNKTTFETFRLRADAAERTLELHELARVLLQINKKRGYKSSRKVNNTEEGSLIDGMDIAKKLYHDNLTPGQYVLNLLESGTKKTPDFYRSDLQSEFDKIWHFQQQFYPELMTETLKEELIGKGKVATWAVLKTPFNLVGIKRNGKRDDIKLENYQWRNLALSVQMDLEQIAIVLQEINGQLANSSGYLGAISDRSKELYFNQQTVGQYQYAQLKKNPHARLKNQVFYRQDYMDEFEKIWEVQSKGREAIFSNALKEELRDVIIFYQRKLKSQKGLISFCEFEQREIEVNGKKKTVGLRVIPKSSPLFQEFKIWQILHNVKLKNKETKEIYILSQEEKQMLFDELNVKGNLSASEVLKLLVDKPKNWEINYKTFEGNRTNQSLYNAYLTILENEGYDVREELKLKMNKDDITLADIDKSATEITEMVRIIFKDLGIKTELLDFNAELEGKAFEQQLSYQLWHLLYAYEEDNSPTGMETLYHLLEQKFGFKKEQAKVIGSIALQDDYGSLSSKALRKIYPFIKENEYSVACDLAGYRHSKHSLTKEELDNRELKSRLDILPKNSLRNPVVEKILNQMVNVVNTIIDTENDQLEKEGKPRNFKFDEIRIELARELKKNAKERAKMTSEINRATIENEKIKTIISRDFSHIQNPTRNDVIRYKLYQELSSNAYKDLYTDTKIDYHKLYSKEYDIDHIIPQSRLFDDSLSNKVLVPRQSNLDKSNNTAYDYISSKGENSLIKFQAVIDSLLKENKISKAKYKKLLMKGSEIGEGFIERDLRDSQYIAKKAKEILFQITKSVLSTSGSVTDRLREDWGLINVMKELNLEKYRLAGLTEMRTTKEGNPKEIIIDWTKRNDHRHHAMDALTVAFTKHSHIQYLNNLNARRNEQSDKKKNIEGIELKETHVVKDGKGNSKRIFNEPIPNFRQIAKQHLEGVLVSHKAKNKVVTKNINRIKGSDKVQIALTPRGQMHKETVYGKIKQYTFKEEKIGAKFDEATIAKVSNPQFRTLLLKRLAENNNDPKKAFTGKNALSKNPILLKNGNELPEKVRLMWLEDDYTIRKDIGPDLKIDKVIDEGIKRILQARLQEFGGDAKKAFSDLEQNPIWLNKEKGISIKRVTISGVKNAEALHTKKNHLGNPILDESGQEIPVDFVSTGNNHHVAIYEDEKGNLQEKVVSFYEAVARVNEGLPIIDQTYNAHLGWTFKFTMKQNEMFIFPSDDFNPQEIDLLDRKNQTLISKHLFRVQKISSKDYMFNHHLETKAIDGEILKTKKSLIGVTHYYIQTPSKLKNIIKVRTNHLGEIIHIGEY

SEQ ID NO: 810 - protein, 1259 aa, Mycoplasma ovipneumoniae
MHNKKNITIGFDLGIASVGWAIIDSQTSKIIDWGTRTFEERNTADKRRAFRSIRRNIRRKVYRNQKFINLILKYKDLFELENISDIQRVNKKDTENYEKIISFFTEIYRKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFSSVRDYAKGPGSEHSASEYGIFQKDEDGKVAKKYDNIWDKTIGKCSFFVEENRSPVNYPSYEIFNLLNQLINLSTELKTTNKKIWQLSSNDRNELLDELLKVKENAKIISISLKKNEIKKIILKDFEFEKSDIDDQDTIQGRKIIKEEPTTKLEVTKHLLATIYSHSSNSNWVNINNILEFLPYLDAICIILDREKSRGQDEVLKKLTEKNIFEELKIDSEKQLDFVKSIFSNTKFNFKKIGNFSLDAINLFLPKMFEQNKNSEYLKWKDEEIRKEWEIQKSKLGKTDKKTKYLNPRIFQDEIISPGTKNTFEQAVLVLNQIIKKYSKENIIDAIVIESPREKNDKKTIEEIKERYKNSKGKNLEKLFKILNLENSRYKLSDLETKPGKLLDKLRLYHQQDGINLYTLEKIVIDDLINNSQKYEIDHIIPYSMSYDNSQANKILTTKAENLKKGKLIASEYIKTKGDEFYNKYYEKAKELFNKKNNTNKTNKKAKKIDYYVDLDEDSAKNRFRFLTLEDYDEFQVEFLARNLNDTRYSTKLFYHALIEHFENNEFFTYIDENSSSHKVKISTIKGHVTTYFRKKANNINKQQIEKNRENNEHHAVDAAIVAIIGNENRQIANLLTLADNKNDKKFILHDENHKENIETGELVKISKFEVDKLAKVEDLEKIIQEKYEEAKNHIPIKFSRKIRNITNGGLSDETLYGFKYDEKEDKYFKFIKKNLVTTENKDLRKYFKNPFGKKADGESEYTVLMAQSHLSEFNKLKEIFEKYNGFSKDSGKAFVEYMNDLALKEPTLKAEIESAKAVDKLLYYNYKSSDEFTYYDNINNKSFKRFYKNIKIIEYKSIPIKFKIVSKHDGGKSFKDKLFSLYSLVYKVYEKGKAIYKSIPVTSQMRKFGISEFDFLDENLYNKEKLDIYKSDFEKPIPVNCKPIFVLKKGSILKKKSLDIDDFKKTKDTENGIYYFISSMTKSSNVDTIYGLRPLNFKIERAVPHTTNPIFKQYIPIHLDELGNEYPIKIKEHNDDEKLMCTIK

SEQ ID NO: 811 - protein, 1356 aa, Lactobacillus heilongjiangensis
MSKKDSEYYIGLDIGTNSVGWAVTNGKYDLLNIKKKNLWGVRLFEAAESAAGRRINRSTRRRYRRRRNRINWLNEIFADELSKVDPSFLTRLNSSWISKKDSSRTRDKYNLFMDADYTDKNYHHKYPTIYHLRRDLMFDDKQFDIRLVYLALHNIIKYRGNFTYDHRKFNVSEMSSNLTKALENFNQELMEFEDAFPDNTDYSAISEVLLKSNNVSTKIDEIISNLELDKDTKKYLKEVLKLILGNSANLNTIFHTSLDKDDEKLSLSAKDIELKLNNLDSLLSDEQIHFISSANELYSSITLNDILDGKTYLSLAKIKQYDTHCSDLQELKEMWYKTTNPDLIKKSRKAYKEYVHGSYNTEDFYKAISPFLKIAIPEDLAKDALKKIDANTYLPKQRTSNNGVIPFQLNLIELEKIIDNQSKYYPFLKENREKIISILSFRIPYYVGPIQAPTDKNFSWMVKKIQAKARPWNFDEVIDREKSSNNFIKRMTTTDTYLVGEPVLPKNSLIYQKFEVLNELNNIRISKNLSQDPLGSKLSVEVKQQIFEELFKRYKTVKSDQLKKWLIRNSYFTDPTIIGLSKPSEFNSSLSTFIDMKAIFGMDFVNNPRNSSQLEELAEWLTVFEDKQILSEKIRHSNYPYSDQQIRKISNMRYRGWGRISKKLLCDIKVESTIYKSHQLHPYSILDLMWSTNNNFYSILHKDKYNFESILEDYNLGTDDKTDINELVDNIHTSPALKRGIIQSINIVKELVKFMGHAPQHIFLEFTREDKTSTLSESRKKRLKKLYNNLSEDTKKFKLDLRDYLVPDKSIQKELESHDKDLSKERLMLYFLQNGKSLYSDEALDINRLSEYQVDHILPRTYIKDDSLENKALVLAKENQRKADDLLLQPSIINKNMERWIYMKDHGMISPKKFKNLTRTTITEDDKVHFINRQLVQTSQIIKNVANILDNMYKEQGTTCVETKANLSSAFRTAFSEQDDKYHFKHPEFIKNRDVNDFHHAQDAYLACLLGLYRIQRFPSDEMLLIKKEYRKFFAQAQNSVKNHGKIPDSQKNGFILAPLVNGETLINNKTMETIWNMDYKRKVIKIFNYKQYNITKRTEIKTGEFYKQTLYSPHDENVKNPIPQKKNLDPKIYGGYSGVQSSYLAIIKVDQKKPTMVSVPIRFSKMIDDGKLSLQSWLENNIKHKKTIEVLKTKIPIGQLTYNPKNGYLSVQSEKEIANAQQLFLPFEHVALLTLLHAPTSEYDQILSFYDTDILLEIFDEITNKIKTFFPFYIDEQEYLVSIRENFQSATVIEKVNVLQQLLIMLHANSSRISIKLGEVSKKDLGRKKKRIPLENTDLVYQSVTGLYQTKFHID

SEQ ID NO: 812 - protein, 1058 aa, Novosphingobium sp. MD-1
MNGLVFGIDLGIASCGWAALRHPTSGDSSGEIVAMGSWMFDVPETDKERTPTNQVRRGNRLLRRVIRRRAQRMAEIRRLFTQRGLLAGNEPDALKRAGLDPWELRARGLDKPLSPAEFAVALGHIAKRRGFKSARKGKEANTAGDDQKMLRALEATRERLGRYRTVGEMFGRDADFRDRKRNRDGLFDRTQSRDDLIHEVGKLFEAQRRLGNDTASTALEAEFTAIAFRQLEMQDSEKLVGMCQFEPKEKRAARFAPSFEKFRLLGKLVNLRITTPEGERPLTPEEVRLATGDLGKTAKLSVKEVRKRIGLPADQRFTAFKPEEEAQDIAARTGEAMHGTRKLRDALGEVLWVELQDKPEQLDQIAHIISFHETADKIGEELRKLGLRAAAVDALLEDLAAFSRFKGAGHISAKAARALIPHLEAGLRYDQACEAVGYDHAASRWSKREQVADKAGFNALVKSMGDEIANPVARKSLTEGLKQLWAMRNRWGLPDAVHIEIARDVGNSLEKRNEIKRGIDKNTAERERQRDEVRELLGIEDVNGDTLLRYRLWKEQAGRCPYTDKAIPATAIIATDNSHQVDHILPWSRFGDDSYSNKVLCTARANQEKKGQTPFEWIMSSQGEDAWNTFLARIEGNTAFRGAKKRNYVLKNAKEAEERFRTRNLNDTRYASRLLAEAVKLFYPEGDRQEKGGNRRVFTRPGGLTSALRHAWGVESLKKVDGKRVEDARHHALDALVVAAIGEWEVQRLTRSYQEWEQKGLARPLRQVDPPWGDAASFRREVKEAYDSVFVARPERRRARGEGHAATIRQVKERDGALIVYERKAVIDLGMEKGKFSKAKALKQLSMLKDRERNLAVAEAIENWIERGRPVENPPLGLPVSKEPDAPRHPILKVRLATEKKPAVGVRGGVADRGEFVRIDVFTLPNKKGEDEFYLVPIYPHEVHSKTPPAAFMTTDGQEKSLTSDHIFKMSIYNRSYVEIEKRDGRVVAGYVVSFDRSVAALKIYEHHTLKPVEKSSGVKTLKRFSKYNVDRFGVRSEVKSEVRTWHGVVCTSPIPPD

SEQ ID NO: 813 - protein, 1281 aa, Candidatus Brocadia sinica
MENFILGLDLGTNSIGWAIIGCDENANPSRLIDANSRIFLSMMEADGKAPKNKQRRDKRLTRRQIRRHKERRDKLLEILVDQHLLPGEFHQPSDWPCLLNQKGKLPNGELKDFLASNPFLLRSEALERNLTRHEFGRVLMHLAKRRGYKSNRGIKYHALFRYIEENKIGIRYAVQGDEEQTETSEYANQHGDKKEAEETGKVWEGIRVLKRQMRSDETIGQFAVRVAHNEKWKIPRRLHTISMDETKIPTKGKSKGQGKTTAYHLHATRELYEDEFSRIWDRQAENFCHLLSQTPAQIKTLREKIEHAIFHQRPPQLQKGKVGMCTIRLKKKRAATALLESQEYLLLQDINNLKYGEVRGRGKRIQMDTHQPLSAGQRQQLLNALSDHKQVNEQNTLTWDRVREILELDASIKFNLEISSNKDKSGEQIKSGKKGITGNRTALAIARVIPEEWKVFTAAQKKSLVNDLLNIHDKVALFNRLRNHYRLPHQRCPWQFSDQQAFELATLELPAGYMKHCFEVITELLRHFRQGMIYSEAKKELEKDPKFKNQSESGQPRHLGEPPDIANPIVQKALYEIRRVVNAIIEKQGCKPKIIRIEMARDMKASKVHRAEMESRNIENRKLNEKAKEAIRDWNQHNPHQTMGLEPANIEKIKLWIEQRAKPDKESTTKIKLWQEQNHRCLYSGRYISFPQIADGEVDIDHIYPRSLSGMNNYLNKVLVFKSENLAKEQKTPWQKWGNSEKYNQIVKRAQEWYGGSDSPLKAKLYKVKNTLDETSFKEEMRKFTESQLNDTRYICVAVKNYLKTLGYTDQEIQVSRGRATADIRRLWELGNILPRAKRDQESKNEDKETDDNEIDEAEGDKTKKGKKKDRGDHRHHAIDAIITALTDRRTFADLQRRYRYYELNSSWPNAPLEKPMRADGKPWESLRHDVEQIVMNRVVSFSATRKASGGLHDEQPYGLGHYKEKMPIKKLLKSPDIIRTLPDKTPGKKLEDSNTWIADAFFRQKLLEWLVNWERAKCVKNFPPPLLPDGKPLDTVAVAHRCYVKRAPVVEALKRIENNPGKKTWVANDELRNILRNWLRQPGNSVKSAQVNPPTMPSKNGNGNPIHTVRLASVSTAMVQFKGKPQIFAKASNHHVAIFKRIGTVVERKGIFVDMLEAAKRIRKPPVVRKSPQELLALDPAVNPAEWQFEMFLCNNDMVLWDVDDPDWQQRDKIYLDEKNHHLPIYRLQKMTKGTLTFRHFSVTSTADTDNRGVLRRSPTKLRCKKIRINELGNYNICHD

SEQ ID NO: 814 - protein, 1383 aa, Kordia jejudonensis
MKKILGLDLGTNSIGWALVHEAENKNELSDIIKLGVRVNPLTAEEKTDFEKGRPLSTNADRTLKRGARRNLQRFKLRRKNLIEILTTHRIIDTHTVLTELGNYTTHQTLALRAKAAKHKIEKDEFARVLLAINKKRGYKSSRKVKNEDEGIAIDGMAVAKELYNQQLTPGQYVYQLLKENKKYIPDFYQSDLQQEFDAIWEFQQQFYESILTDELYTKLKGQGQQNSRKLFLAIHQIYTAENKGKRNDVRLQQYAWRNEALTKQLSIAEVAYVLVAINNEINKSSGYLGAISDRSKSLYFKNVTVGENLYAQLQKDRHTSLKNQVFYRQDYLDEFEKIWETQAQFHSELTAELKKEVRDVIIFYQRKLKSQKHLISDCQFEKGHKAIPKSSPLFQEFKIWQNLNHLEFEHTQTNEKIKFTEFEDEVRQFVFEELNLRGTLKSKELKKLLQLKTPNYWKANFEEIEGNRTNEVLYNVYQRIAEIEGYGFDWSKKTAEEIHTELAIIFKEAGINSEILTFDTTIEGNNFDKQKSYQLWHLLYAAEDGKKITEADRLLYGDTNVALKKKLHETYGFKPHYASLLVNVSFQQDYGNLSSRAIRKIIPFLIDGHGFSEAARLAKYNHSHSLTAEEQENRILNEKLSLLKKNELRNPVVEKILNQMVNLVNQVIETYGKPDEVRVELSRELKKSAKERADMTKHINEATAKNQTIRKLLQKGFGIQHPTKSDIVKYKLYEELSLNGYKTLFTNTYIPKEKLFSKEIDIEHIIPKAILFDDSFSNKTLAYREVNLAKADATAVDFITNKHTSDLDSYIARVETLYHSKKISKGKYKKLLISRSELPEGFIERDLRNSQYIAKKATQMLKEVFRTVHSTSGRITDKLRKDWDLINVMKELNLPKYQALGLTEKQIRKNGNSVEIIKDWTKRNDHRHHAMDALTVAFTTHDHVQYLNNLNAIYGLKDEEIDHNKSNLKGIKNKITKVYVKDGNKKRKFIPPLKNFRTITKDHLEQILISFKNKNKVVTKNKNKTKTSQKGVLNEKVQLTPRGKLHMETVYSHTKKVIVAQEKVSSKFTIEKVQQVTKPTYREALLKRLATYDNDPKKAFAGKNSLSKHPIYLDETKTKLLPEIVKTQYFEDNYTIRKEINPDNFKDEKSLLKIIDLDVQNILKQRLQKHNGNVKLAFSELEKNPIWLNKEKGISIKRVRIDGIKNAEALHSKKDHLGQPILTKNGKSIAVDFVSTGNNHHVAIYKDQQGKLHDVVVSFYEAVARVNLGIPIIDKTLNENLGWKFLFTMKQNEMFVFPSENFNPKAIHLKEQKHNTIISKHLFRVQKFSFRDYVFRHHLETELIDKKELKEITFFRLKSLKIVDQIVKVRINHIGNIVHVGEY

SEQ ID NO: 815 - protein, 1086 aa, Verrucomicrobia bacterium IMCC2613
MSQVTGLPLVLAFDLGKGSIGEAVRLGNDFVHVASWLIPQDLAARGPSAKPGTPASRYRAWRTRVAHRERENALRRICADAGIEVLAAKRVARDAADKKKWIVVSKADERLTREFPKKGDSTCYNSALLRIQLLRGVKLEGWQVFKALHAAIQRRGYDNAVPWKHRAVRDTETEEDGITQQRADSYCLALEQMAPNKPECQLPSYLDAHRLGLWDASRPDEYILRIDHHVAPARNREHPDNTPIVAPRELVIKETRALLTAAAKFFPKLAGREDEILFGRGGKAYASYFDDVRRAHSLRLGGANDWDGILGQKVPRFDNRIIAKCALIPRLNVCKATTRKDKTGAIISESLLPSEVTFLFKLKNVRVQRPDKSITGLKPDEIRTLFNDPKREPEKLSYTKKQWSKEIARFGCEAAAGHEEIAAPSFGGRSRFCRPALEILKKLILSGESPATAHSRELAERVKGNTNPQQGLVVSDLDFLSPARIGETWDGIHVADQQHGALLRLAAEQGPEVAIRALIGKVNNPVVRHRLEAFWGRLRAIEADLKKRFGRGPDEIAIEFIRTDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTALAETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYERSELEATAFGQRTLGGKLYGVARVDFCNLVVKVALNGNRSLNIKPDGSGEADTIVDQAIRRDVQAFIDQNRATITLAIWDAWVSSYHRGGSNGPLVKKVLVTITNPDSLEEYADLAKDQSGQLRRGKKHKGYWILRILSPTKKDPTKTTLQVRPIYAHANPHALKAEIGEDHGCEIILELESGCLVQIDKPIAHAKTPLAAGIYKLNSVWTQGNVVVSSQSGVTSAPIGLAKFIEAGLRRLK

SEQ ID NO: 816 - protein, 1269 aa, Elizabethkingia anophelis
MKTIMVKNILGLDLGTNSVGWALIEVDENNLPIRIIAMGSRIIPLSTSDKEEFQRGLSITKNQSRTVSRTQRKGYDRKQLKKSDLKKILNKYNIFPSEELLRLPMLDLWKLRSDSANPDENISAEQLGRILYMLNQKRGYKSARSEANADKKDSDYVQAVKGRYDQLKDRKQTIGQYFYDELYNANANNSYFRIKEEVYPREAYIEEFDTIISAQREKHDFLTDEVVHQLRNEIIYFQRKLKSQKGLVSICEFEGFEKTVFDKEKNKNKVFFVGPKVAPKTSPLFQLCRIWEVVNTITLKIKNPEGSKYKWGEKIPDLKEKEILADYLFKNESLSFSKLLEILELKKENVYVNKQIQKGIKGNETYSALHSILGDNELLNFDVSIMTSNQTALLVDRKTGEILEERAGLELDASLEKEPLYQLWHTIYSLKDLDECKNALIKRFGFDEETAEKLSRIDFNKQAFGNKSNKSMRKILPFLMEGYDYSQSSSLAGYNHSNSLTKNEREQQITLDRLELLPKNSLRQPIVEKILNQMINVVNAILEQYGKPSEIRVELARELKQSKEERNETDLQNSKNKKLNDEIGKRLAELGLPVTKRYIQKYKFIFPSLSKNLKEAYVNNQCIYCGETFNLTEALSGDAYDVDHIVPKALLFDDSQTNKVLVHRKCNSTKTNQTAYDYIATKGEEEVRVYSERVDDWLKRGIISYSKMQRLKVSHKEYLERKKLGKETETDRKLWENFIDRQLRDTQYISRKSREILQKVCNNVTTTEGGVTAKLRNLWGWDDVLMNLQMPKYKELGQTITKEWTSEHGKRKHQKEEIENWTKRDDHRHHAIDALVIACTKQGFIQRINTLNSSDTKDLMIKEVEEAKVEFNEKTTLLEKYLKTQKPFSTHEVMKEADKILVSFKAGKKVATITKFKATGKNKETGVIVPRGALHEQSVYGKIKVIEKDKPLKYLLENSDKIVNPRIKNLIEIKLSENKNDPKKALLALKKIPIFLDEEQSITLEKASCYNNATVLKYKLQNLKAAQVDDIVDEKVKKIVRERLSQFGNKEKEAFKDTLWFNEEKQIPITTVRLFARPDANNLQTIKKDEDGNGIGFVVTGNNHHIAIYEDKDNKLVQHSCTFWHAVERKKYNIPAVIRNSADVWSQLLGKELPESFLDKLPADELNLKLSMQQNEMFILGLSQDEFDEAIANNDKSLLSKHLYLVWSISNNDYYFRHHLETKNTELKNIPTAKDAKRYFRFKSVGALVGINPVKVRLNHLGEITKIGE

SEQ ID NO: 817 - protein, 1371 aa, Lacinutrix jangbogonensis
MKKILGLDLGTTSIGWALVNEAENKSENSEIIKLGVRVNPLSIDEKTNFDKGKPISTNADRTLNRGARRNLQRYKQRRENLFEILLDNKLITKETILTETGNNTTHETLRLRAKAPNERIELDELARVFFSINKKRGYKSSRKAKSEDEGNAIDGMSIAKELYENNITPGQYVYELLLNKKKYIPDFYRSDLQNEFNIIWEYQKQFHSNVLNDEMYKKLEGQGQQNSRKRFLAIHGIYTAENKGKRDAIKLQHYKWRAEAITNQLPIDQVAYVLVEINNNLNKSSGYLGAISDRSKELYFKNETVGENLHRQIKENNHTSLRNQVFYRQDYLDEFEQIWVRQAKYYSELTLELKNEIRDVVIFYQRKLKSQKHLISNCQFEKQHKAVPKSSPLFQEFKIWQNLNNLVFKNTRTKEKCVLDDDLRISLFEELNLRGNLTEKTILKFCNLNSTWKSNFTKGLEGNNTNKALYNIYQHIATEEGYGFDWEKKTTKEIKEELKSIFPRINIDTTILNFETNIEGQTFDKQTNYQLWHLLYSAEDDTKILEEDRLVYGNSNVALKKKLHTKYGFKPEYATMMANVTLQDDYGSLSSRAIRKIIPFLQEGNEYSESCALAGYNHSSSLTKEELEKRILKPRLEILQKNSLRNPVVEKILNQMVNVINQIIDEYGKPDEIRIELARDLKKSAKQREETTKFINSATKVNDDIKSVIQKEFGFTPTKNDVVRYKLWLELKNNGYKSLFTNKYIPKEDIFSKNIDIEHIIPKAILFDDSFSNKTLAYRAVNLKKADRTAIDFIEQDYSNEDINKYRLRVESLYKNGDIKKGKYKKLLMSLANLPTDFIARDLVNTQYISKKAKSMLFEVFQNVVPTSGRITDKLRGDWDLINVMKELNLHKYRSLGLTEIQERKNNVKIEIIKDWTKRNDHRHHAMDALTVAFTTHNHINYINNLNASRNKESHLFSIKNTITKVYEDTTGNKKRNFIQPIENFRTEAKKHIESILISFKNKNKVVTKNINKSKLKGKDNFNAKPQLTPRGQLHKETVYGTSKREMDKPIKLSKKFKIETLKLIVNSNLKTVVTKHLHKYNNKPEIAFDSKTIKKDPILYKGLQLTEVLCFEEIYTIRKVVSPDNFKTEKDLNKIIDKKTQEVLKNRLNEFGGKPKEAFSDLDKNPIWLNKEKGISIKRVTITGVSNAEPLHYKKDHFGSEILDKKGNKQAVDFVSTGNNHHVAIYKDDKGKLQEKVVSFYEAVARVNEGLPIINKEYNTGLGWEFLFTMKQNEMFVFPNDDFNPIEIDLLDEKNEILISKNLFRVQKISTKNYMFNHHLETQVVTSEILKTKKQLSGITYHFIQSTEPLRNIIKLRMNHIGKIVYVGEY

SEQ ID NO: 818 - protein, 1516 aa, Prevotella sp. P5-119
MKNILGLDLGTNSIGWSVIQEKHNENNECQKLILGAGSRIIPMDAAVLGDFAKGNTISQTKDRTQYRGVRRLRERCLLRRERLFRVLDIMGFLPQHFSNALTRYGKFKDADEEPKIAWRKDDEGKMHFLFADSFNEMIEEFRSVQPELLKRGMKVPYDWTLYYLRKKAMREAVTPFELAWLILSFNQKRGYYQLRGEEEGEADNSKSEEYLAQRVVDVIDTGEKKGKSTWFDIVLENGMVYHRPAEIKPDWIGKTKEFIVTTQFDKDGNPKKDKEGNVKMSFRMPNENDWNLQKKKAEKDIDESGMTVGEYIYNALLHNPKQKIKGKLVRVVERKYYKNELQKILESQKRFIPQLSDSALYEKCIKELYQSNEAYRNSISTRNDFTYLFVDNIIFYQRPLKSKKSLIDNCPYESLAYTKDGEEHKAPVKCIAKSHPLYQEFRLWQFISNLRIYQRQKQVGDKVKLDVDVTDEFLPTDDRRESLFDYLNDKTEIKQDVLLKEFFSMKKPKGKDSVYPYRWNYVEDKSYPCNVTRGKILAKLNRAGISADFLSSNGNEESLWHILYSVEDKGELRKALARFAAKNGLDDAFTEALADIEPYKKEYGAYSAKALKKLLPLMRLGKYWNYDNIAPATKARISKIIDGEYDENIRNRVREKAMSLNSASQFQGLPLWLACYIVYDRHSERADSGRWSSPEDIDKYLSDFKQHSLRNPIVEQVVTETLRTVRDIWKRYGEISEIHVELGREMKNPADKRSKMNRRMLENENANMRAKLLLTEFMNPEFGIENVRSYSPSQQELLRIYEDGAISNAGSEIDDEISDIMSRLSQVDVKKQPTASEVKRYILWLEQNYRSPYTGQMIPLAKLFTPAYEIEHVIPQSRYFDDSFSNKVICEAEVNKLKDRMLGYEFIKQHKGEKVSLSMGGTVEILSPEEYVRHVESQYKNNKAKMRKLLMDDIPDEFINRQLNDSRYISKLIISLLSNIVREEGEEEATSKNVISCNGSITDRLKKDWGINDVWNHIILPRFRRLNELTGTDKFTTSNKEGHEVPEMPLELQKGFNKKRIDHRHHAMDAIVIACITRDHVNLLNNEAAMSKNNANRIQLSKKLRRYESVEIEKDGIRKQISMAKEFKKPWEGFTADVERTLRDIVVSFKQNLRVINKTTNYYQHFKDGKKIYSPQSKGDSWAIRKSMHKETVFGEINIRRIKEVSLKEAMKRIKDIADKELRSKIVELMALQYNEKKIKQYFSDNKDEWSDVNPKKIKIHYFTKETNERFFATRKPLDTSFDKKKIKTQVADTAIQKILLNHLSAHGDKAETAFSPDGIDEMNRNIIELNDGKFHQPILKVRIYEKADKYAVGQQGNKKKKYVEAAKGTNLFFAIYAEEKIDEKTGDTVITRTYDSIPLNVVIDREKRGLSPVPENENGAKPKYVLSPNDLVYVPNEEERETGRICEPLDKERIYKMVSSNKKQAFFIKSEVASTIVDKFEFSALNKQERALSGEMIKEICIPISINRIGEITLR

SEQ ID NO: 819 - protein, 1056 aa, Endomicrobium proavitum
MPKQELVYSFDLGSGSIGVCVRSGKNILHLNSLLLDNEFASVKEAAAQRRQIRTRIAHKEREKWWNEQAKKAGIEVLQTAQPTKENPNLKPDSRMLIEFLPKNSKDKTIYSSHLLRIALLQGIKLESWQIYKAIRSAIQRRGYDANLPWATDYDSDTKANSDAATRYEEKLKEFFADKEEYYYPCYYEAYIQSIWSPSNPKDLSGRLSENPSPARNKDNKPQEDKCFPSRDLVEKELKDLLSAAAKLFPKLKDKENYVLYGQAQRAYASYEYKKDIDKENYISHRGTSWDWQGLLGQKVPRFDNRIIAKCRLIPRFNVCNAKKQINKEVSFLLALKNMRFTLDNTTTQSLNCAQINEIFKTYAEFCEYEKQKETAVAKKQNPCTKTFWKNYVHALGGEVNPGQQEIAKPKEGGRSSFCKPALNILHSLILSGKTPHNYYAELVEQTKNTDLQKGLIKDDYRFLLNMPNDWNSISIQDTREEDKKLSQQEALRKIDEIIAGVNNRIVCHRLLMLKQVLQKLDDQFNKEYGVPDKVVFEIAREDFMGKKKKDEYLKKAKDGKKNNDDAVKKLKDMGLPVSDPNIIKIKLGNEQKWKDIYDTSDKRNLIPENIGQYEIDHIVPRTSSKGGSDSFVNFILTKNALNQTKKDRTPYEWLSSDNSKWQAYLANIADFSKSANSKKIELLTSDKAENIEKRKTDLQATSYLEKLAQTIAGLYFGFGINTKDDKKRILFFTGGETATVRSKLDLNRVLYKNDEEFEKAQKAGLKEKNRKNKKHHALDALVLSMLPEIKVSKREIIEKPDYFHKDYCVKQLKSIIPQTIKQIKPKLRATIYALRSRYENGKPYYYFISRFNSNLTLFEKMEDAKKEITNIFDLKIKNDWKVKLEEKGLTQEKWIEFLNKYTNNGKRIKQIAMTDSKAFKKEETFNSNGIIKNVIGEYGSNGVKGQWIKGKEGHQGQIVYKDEKGKWRVEPVYVFESIYNKKKLYENKYKDVRFLKSGQLVELKKDYENIKAGIYILRTLKSNGSCKLEDINTQEEIDKSVNVLIEQCGMRSYEKK

SEQ ID NO: 820 - protein, 1069 aa, Spiroplasma litorale
MKKVNIGLDIGIASVGWSIYDIDNKKIINAGSRLFSESNSGSSNSSTTSDRRMQRGRRRNLRRLILRKQDLLKLFVKYNYLNKTNDFYNLNLNINYLEMRKKALKEKIAQEELIVLLFNYIKKRGSFNYKDDLLESKKDKFDDISIDDIKKETNLLPVEIQTNIFNEYGKYRGVKETDSLIAHEWYKKELEQILNKQVEENVVSQSFVQEYINLFDRKRLYFEGPGWTTSSKTSKSEYGWKDENEFYSRLTGFDTYNSNEKRAPKHSMTSYLFNILNDLNNINIDGIESGLTYDQKYELIESVINHNGPKNKNITLKLISSLLKVKESDIKGYRIDKENKPNFTKFEFINKLRTLLINSKLDISFISLKNIDLLDKISEILTIYQTAESRKEKLLIDCDYSFSNEQAEVISFISLTGTHSLSFKTMKVAIDEMWYDNKNHMQIFAEKNIKPDYNIKINRKFNSMPLLRQKISEMYISPVVKRSLIESIKIIKEIEKIKDLQIKDIVIELARESNSSDFKKYINEIQKKNEIENKEILEKHKVSLLKKDFKTRLKLILFNEQDGRCAYSGTPIDIDRLYSDPNYCEIDHIIPFSVSLDDSRTNKVLVLWKENQDKGKKSPYQYFRDKNRNWNEFKEKMYSLYVKNKKLGKYGNKKYSNLVLEEDINDVEVKQKFINRNLNDTRYATVEVKNYLTFFKKELNKSYSIKTINGGLTSYIRNVYLKLPKKDRDDYKHHAIDATICAIAPIIDLAEGKTLNKILDSDDENIVLKLEELGDLKNDINNFAYKFTKKVEKKSNTQLFNESIYRCINDNGNLIKTEKIDLLSLEPPKIKIIKELFTTNKNKLLIYESDKKTFDYLENIYKAYVNDVDKNDKPVKNPFYHFVNELGERITKQSNENTPPSIRYLRYKGSVINQYTKITHKFNKIKANKEIVMIGSNTIGWDLFYSKVYNLYKVLPITHNVAYFESNKSSSNIKYKLKKYESEKILYKIDETYEKKFTLHKNNELVFDYDGQKFNLIVVGFDKTHERLEFKYLYKKVDDNKRLHKTVKKMKNIKLITSNSTRTKVKIID

SEQ ID NO: 821 - protein, 1058 aa, Staphylococcus schleiferi
MKNSYILGLDVGIASVGYGLIHSDSKSVIDAGVRLFPEANVENNEGRRAKRGSRRLKRRRIHRLDRVKNLLAQYHLIIDDKIPKSTNPYAIRVKGLSSPLSKSELVIALLHLAKRRGIHNVNVVMDENESTNELSTKEQLKENAKQLENRYVCELQLDRLNEQYKVRGERNRFKTEDFVREARQILTTQQKYHDIDEHFIEQYTHLLETRREYYEGPGKGSQYGWDGDLKQWYEMLMGRCTYFPEELRSVKYAYTADLFNALNDLNNLVIARDENEKLEYFEKYHIIENVFKQKKTPTLKQIAKEIDVKESDIKGYRITKNGKPQFTSFKLYHDLNKIFLDKKNLENIELLDEIAFILTLYQDPLSIKEALDQLQDLLTESEKEAIAHLNGYTGTHRLSLKCLHLLIDEMWQTSRNQMEVFTALNLKPQKYQLSKQKQIPKNMVEAFILSPVVKRSFIQSIEIVNSIIKKYGLPEEIIIELAREKNSEDRRKFLNRIQKENENTRKQVEEVIREYGNRNAKGLVEKIKLHQMQEGKCLYSLQNIPLDDLLRNPSHYEIDHIIPRSVSFDNSFNNKVLVKQEENSKKGNRTPYQYLNSNESVLSYVQFKQHILNLSKSKERISKKKREYLLEERDINKFEVQKEFINRNLVDTRYATRELVQLLKSYFSANDLDVKVKTINGSFTNYLRKAWKFDKSRNKGFKHHAEDALIIANVSYLFKQSKELKEANAILENNNLSLNKNKDSKNLLTEQDYRKMFEIPKQVQDIKDYKDFKYSHRVDKKPNRQLINDSLYSTREVNENHYIVQTVKDIYAKDNTKIKDLFLKTPEKLLMYKHDPQTFEKLMLVIKQYGEEKNPFAKYYEENGEYLTKYAKNDKGPTIKRLKYIGKKVGTHLDISRNFSDAKRKVVQLSIKPFRFDVFHSKAGYHMLTLTYMDIKKKEKHYQILKNEYQALKERYKVPSDAQFIGSFYYNDLISINDELFRVIGVNNSTRNIVELNMVDINYKDYCDLMGIKKTPRIFKTIAKKTEKIEKYSTDILGNQFKVKPSKSPQLIFKRGVL

SEQ ID NO: 822 - protein, 1536 aa, Parabacteroides sp. D26
MIIYFIFEKIVNTILVMKKIVGLDLGTNSIGWALINAYIDEYNKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGEKKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIITRLGKAHIPKAFLSKEKEETLWHILYSIEDKQEIEKALHSFANKNNLSEEFIEQFKNFPPFKKEYGSYSAKAIKKLLPLMRMGKYWSIKNIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKSPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSLNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 823 - protein, 1090 aa, alpha proteobacterium AAP38
MRWRLGLDMGAGSLGWCAVGLDDQGYPDSILAAGSHIFGDGRAPSRGDQQGTPLGVERRAAKAMRRRRDRFLGRQAKLLARLTLAGLFPADPVRAKALELLDPYVLRARALDEALPPHQLGRAFFHLNQRRGFKSNRKTDRGVDDEAGKIAIGIDRLRAAIAAAEARTMGEFLHKRRQSAPDVNQIPSVRTRLRPETGEEAKGDGYDFYPGRELVEEEFDAIWDAQAPHHPSLLTPDNRALLHEAIFYQRPLKAPKIGKCTLLNNEPRLPKAHPLFQRRRLLEEVNALRIVRPGEVATKLTCEQRDLLMLKLKDKAKVSFETLRSKVLKLEPEARFNKEGENRTELVGDEVCAQMSAKTRFGKAWAHFTDEKRWAILSRLIEEEDEERLDTWLRTEHGLDAEQARAVAGARLPAGFGRFGETATRRLIAALQAEVIVYSEAVVAAGLGHHSDMRTGEVLAELPYYGMTLERHLLPGTGDKADPEELRIGRLTNPTVHIALNRLRRIVNRLIKTYGRPEQIAIELGRELKLTDEDKQRLSRQNNRNRADAEARSKKLAELGQADNGANRARLKLWEELNRENALDRRCIYSGQQISIAMLFSDAVEVDHILPFDATLDDSNNNRILCLREWNRRKRKQSPYEAWGHTDYWPDIAARAARLPKEKRWRFEPDAMQRFSAEDRFIARHLVDTQYMSRLAREYLEALYPEKGEGSGHVWVSPGRLTELIRRKLGLNELLPDHNFAGVKNRLDHRHHTIDAFVVAVTDRSLLQGISRASALEGEEGRERVIVPEPWDGFREALRTTLNTITVWHRQDHGTASKAGLAQGRDQTAGKLHNDTAYGLTGRQDTKGNDLVVSRKPLMSLKPADIEPVPDVAPITKGVRDRDLRKALAHFTQATEGKGFLQALERFTRLGPLHFRGIRRVRLIQPLAVIPIKGPGGVPYKGYLGGENFRCDVWEMPDGAWKPEVTSMFQAHQPGWTSAIRAACPTARKVLSLHKRDMIAIEREEGVRTLMVVAQIWSNGQVTLVEPHEAGDLNKRNKSEDDPFGYFMPTAGGLKRLKARQVRVDELGRVQDPGFPARKARRRTRPKQVD

SEQ ID NO: 824 - protein, 1409 aa, Riemerella anatipestifer
MKTILGLDLGTNSIGWALVKEAENSNEKSEIIKLGVRVNPLTVDEKTNFEAGRPLSTNADRTAKRSARRNLQRYKLRREDLIELLIKHQLIDKDTPLTEIGKNTTYQTLELRAKAARERIELEDLARVFLAINKKRGYKSSRKVNNEDEGQAVDGMAVAKKLYDENLTPGQYAYELLSKGKKYVPDFYRSDLQAEFDRIWEYQKQFYTDILDDELYNALKGQGQQNSRKRFLAIKGVYTAENKGKRDEVKLQHYKWRSEAISKKINIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKSTQLPKRQTVGRRVAPKSSPLFQEFKIWQNINNLEVIKISEGVSKNKKETETLSDDERKLLFEELNLRGNLSQKEVLQILGLKDKEYKTNFPEGLEGNRTNAALFNVYKAIAENEGYGFDWEKKVAKEIREELKAVFSQIGIQANILDFNANLDGKEFENQASYQLWHLLYSAEEDDKINEEDQIIYGNSAVSLKKKLCEKFGFTPEYAKWMANVSLQDDYGNLSTKAMRKIIPYLIDGNDYSEACALAGYNHSNSLTKEENDNRELLNKLELLPKNSLRNPVVEKILNQMVNVVNQVIETYGKPDEVRIELARELKKSAEERAEMTKGINEATRRNEDIKKLITKDFGIPNPTKSDVVRYRLWEELAPLAYKDVFTGKQIKKEDLFSSKIDIEHIVPKALLFDDSFSNKTLAFRETNLKKGDRTAYDFIESDYNATLDDYIQRVETLYNNAKGTISKGKRNKLLMAQKNLPDGFIERDLRNSQYIAKKAKAMLYQVFKDVNVTSGSITDRLREDWDLINVMKELNFPKYKALGLTEIEERYDIGQEKTKKVEVITDWTKRNDHRHHAMDALTVAFTTHSHVQYLNNLNTIHSLKGDEVDLELSKLYGLKNTITEVVNKKRKFIPPMPSFREEAKKHIETILVSIKNKNKVYTKNINKTKKESGYHTKEQLTPRGQLHKETVYGKSKRPMNKPTKINKNFSLKQAQLIINVQEKELVLHHLAQFDNNPEVAFDTKTLKKTPLLKNGEPLKEVLCFEEIFTIRKDITPDLKIEKVVDEKIKAILEQRKKDFGGNTKEAFSNLDKNPIWLNKEKGICIKRVTITGVSNAEALHHQKDHLGREILDDNGNPIPTDFVSTGNNHHLAVYLDSEGKLQDNIVSFYEAVVRTSQGLPVVDKGLNKDLGWKFLFSLKQNEMFVFPNDDFDINDFDLLDDNNAELISKHLYRVQAISKVPVGNSFARDIIFRHHIETTVERKKELKDISYIQLKSLEGLRNIKKVRINHIGKIVQVGEY

SEQ ID NO: 825 - protein, 1358 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKTGFGKLQVPGGLKLTDQAEIIYQSPTGLFERKVALKDL

SEQ ID NO: 826 - protein, 1078 aa, Neisseria sp. 74A18
MKQQPQRYILGLDLGIASVGWALILVDEEGNPIGLLDCGVRTFERAEVPKTGDSLALARRQARSVRRLIRRRAHRLLRLRRLLKREGVLSAADFNSDGLPNLPIDTWQLRVAGLERKLTNQEWAAVLLHLVKHRGYLSQRKSETQTENKELGCLLASVAKNSKLLSENANQYRTPAELAVRLFAEQSGHLRNKGGDYTHTFNRLDLQKELHLLFEQQRTFGNPFASAELQSKVDGLLMMQRSALQGEAVLKMLGKCTFEPSEYKAAKHTYSAERFIWLTKLNNLRILENGTERALNEAERKLLLDEPYKKAKLTYSQARKLLDMSHDATFKGLRYGKDSEGLNAENGALMEMKAYHKIRTVLDKAGLKGEWENRIRNPEILDKIGTAFSLYKTDEDIQAALADLRLPENVLNALLAGLNFDKFIQLSLKALSNIMPLMERGIRYDEACKEVYGDHRALAESKNQMLLPPIPANEIRNPVVLRTLTQTRKVINAIIRRYGSPQRVHIETARELGKSFKDRKEIEKRQEENRKERERAAEHFKELFPHFAGEPKGGDILKLRLYEQQQGKCLYSSIPIDLGRLNEKGYVEIDHALPFSRTWDDSFNNKVLVLGSENQKKRNQTPYEYLDGASNSQRWREFQARLQGCRFSYAKKQRIQTAKLDSKTEQGFLERNLNDTRYIARFLCGFIEENLHLQGEGKRRVFASNGQITALLRGLWGLKKVREENDRHHALDAIVVACSTVSMQQKITKAMQRRETLETVDTETGEVKTRIPQPWDFFRQEVMMRVFSDTPHEELAEKLSGRPEALHDFVSPLFVSRAPNRKMTGQGHLETVKSAKRLSENISVVRKPLTALKLKDIENIVGYPDREPALYQALRERLQAYKDDPVKAFAEPFYKPAKNGGQGSLVKAVRVKDVQKTGVMVRKDRGGIARGIADNATMVRVDVFGKKGKNYLVPVYAWQVAKGILPNRAVVAYADEADWDEMDDSYEFKFTLYPNDLVEIISKKGRIFGYYSGLNRATGAIDIKEHDLSKEKAKNGIHQSVGVKTVLSFQKYQVDPLGKEICLCKVEKHPELNSKKKK

SEQ ID NO: 827 - protein, 1029 aa, Pelomonas sp. Root1237
MKYRLALDLGSTSLGWAIVQLNAKDEPCAIVRAGVRIFPDGRNPKDGSSLAVTRRNARAMRRRRDRLLKRKARMQRLLIEHDLFPADEAARKALETLNPYELRAKGLDAALTPAEFARALFHLNQRRGFKSNRRTDRKDNDSGALKAAIGGLRAQLDTAGADGRARTVGELLWRRMSDPNVLTVRARYREQRITKDDGKTRVDKSYDLYVDRAMVEAEFDALWAKQAELSPTQFGEAARATLKDCLLHQRNLRPVRPGRCTLEPDEPRAPLALPSQQRFRILQEVNHLRLLGGRLLEESLSVEQRDKLVAALEDGSKSFKTAIPKLLGLPGTVQFNLADAKRTELKGNATSMLLGKKDFFGPAWHGFSEARQDEIVMRIQEEESEARLVDWLATSTGVDEAHALKIANAALPEGYGSLSAKALAKILPAMRAEVITYDKAVLAAGYDHHSHISHAASTGEILPELPYYGEYLQRHVGFGTGELNDTPEKRFGRIANPTVHIGLNQVRVVVNALIKRYGHPTEVIVEVARDLKQSQDQRRETQEQQAKNQKRNERLRKDAAAILGIADERVRLADIQKLILWEELSFDIADRRCPYSGVQLSAAMVLSEQVEIEHILPFSMTLDDSLNNKTVAMRLVNRLKGNRTPWDAREAFAGQGWDYDGILMRAERMPRAKRQRFAPDGLEKWLKEDKDFLARALNDTRHLSRVAREYLSLVCPASTRVIPGQMTAMLRAKFGLNDILGLNGEKNRNDHRHHAVDACVVAVTDQGLLQRFAQASADARGKGLDRLVETMPDPWDSYREHVQRAVNSIWVSHKPDHGFEGAMHEDTTYRPPHLDPKNMWRTRGIGGGKPNEKEADSKAMVGFTGPEHLQRHHRDKAGQQLPYKGYVASPKFCMDIVRNDKGRWEGEVVSTFEAYRLVSEFGRDAALAHIQSKSRSISGKPLVMRLQGGDMVRFDDDEGRPVVLRVVNMTGNGQIFFAPHNEANGDARNRDKQDQFVYLSKYAGSLQKARGRRVTVSPAGELRDPGFKE

SEQ ID NO: 828 - protein, 1100 aa, Devosia sp. Root635
MGATIVTDISRSAFAFDIGTKSIGSAVLRLDDRGEPIGIINAAVRIYADGREPKSGTSLAEGRRLARGMSRRRDRYKRRRRTLLNTLTEFGLMPPTDEARKALLAETNDRRFGAVAGNVYALRARALDEKLPLHHLGRALFHLNQRRGFKSNRKTDKRDNDQGKIASGISRLGQKLDEAGARTLGEFLHRQHSAGKWVRVRPSRVPSKDDKEEDGYGFYPERSFLEREFAAIWKAQAAFYPELLTEERGDHLHRVMFFQRPLKRPKVGKCSFYPDEDRLPKAHPLFQEFRLVKELNELEVVHRGDRREKLTLEQRDTLFNQLRTQRSSAFTALRKTLKAPTGTRFNKESDARDKLKGDEVAAEMSHKDRFGQAWIGMPLAERWAVIEMLLDTEDPLEVKAWLEEHYGFAADRIDAIAAAKLPPGYGRLGETALRDMLDELKNGTVKDDSGRDVVLTERQAMDNIWKDNPALQRVVADARELPPYQEVLGRRIPPGTGKPEDPYDVQKGRLTNPTVHIGLNQLKRVVNALVRRHGRPDQIALELARELKLNEEQKAEKDREIARNTKAAQARSEKLRQLDIDDNGYNRVLLKLWEDLNLRQPENRECIYCGKAIGIGTLFSNQVDIDHILPWSKTLDDSQANRIVCHVECNRQKGNHAPAEVPQWHDRYDDILARAERLPRNKAWRFGREAMKKFKDDESFLARQLTDTQYLSRMAHEYVAALYPDEEPDEWGVFTRRNHVRVIPGRMTEMLRRQWGLNAIISDHDQKNRNDHRHHAIDAIVVGVTTRRLLQRIATAAGGREALALEETIGKIEPPWPGFYDDVKEAIDRIVVSHKPDHGSLPKPGEPARTAGQLHNDTAYGFTGEERKGVPIMVHRVPFATLTEKDIPSIRDRQLAEALYGAIAGISGKAELAAALARFSASGPYKGIRHVRVVEPVSVIAIKDRDGTPYKGYKGDANYRYDVWELPNGKWTHEVVSMFDAHRPDWQSEIRNKNPAARKVLSLHQNDMVAYEHPQDGYTIGRVVKFGSGGQMALAGNREGGALKSRDADPEDRFRYFYKSGGAMRDARLRQVRVDETGRVFDPGPQDRESRNARKQSAAG

SEQ ID NO: 829 - protein, 1287 aa, Chryseobacterium sp. Leaf201
MKTVLGLDLGTNSIGWALIELDENNIPIRIVAMGSRIIPLSTSDKEEFQRGLSITKNQSRTVSRTQRKGYDRKQLKKSYLKKILNKYNIFPSDELLKLPMLDLWKLRSDSANPNENISAEQLGRILYMLNQKRGYKSARSEANADKKDTDYIQAVKGRYAQLKDRNQTIGQYFYGELNDANENNSYFRIKEEVYPREAYTEEFDTIINAQKDKHDFLTDEVIHQLRNEIIYFQRKLKSQKGLVSICEFEGFEKTVFDKEKNKDKVVFVGPKVAPKTSPLFQLCRIWEVVNTITLKIKNPEGSKYKWGEKIPDVKEKEILADYLFKNESLSFTKLLEILKLNKNNVYFNKQILKGIKGNETYSILHSILGDSELLNFDVSIIPSNHTSMLIDKKTGEILEERAGLELDTSLEKEPLNQLWHTIYSIKDLDECKSALIKRFGFDDETADKLSRIDFNKQAFGNKSNKSMRKILPFLMEGYDYSQSCSLAGYNHSNSFTKDEREQQITLDKLELLPKNSLRQPIVEKILNQMINVVNAILERYGKPSEIRVELARELKQSKDERNDTDLQNSKNKKLNEEIGKRLAELGLPLTKRYIQKYKFIFPSLSKNLKDAHVNNQCIYCGETFNLTEALSGDAFDVDHIVPKALLFDDSQTNKVLVHRKCNSTKTNQTAYDYIATKGDEQVRVYSERVDDWFKRGIISYSKMQRLKVSHKEYLERKKLGKETETDKKLWENFIDRQLRDTQYISRKSREILQKVCNNVATTEGGVTAKLRNLWGWDDVLMNLQMPKYKELGQTVVKEWTSEHGKRKHQKEEIENWTKRDDHRHHAIDALVVACTKQGFIQRINTLNSSETKDLMQQEIKEAKKLLGENYNEKEFENNNESVKNHKERLSQLDDYLRLQKPVKFDTKYVEQEADKVLVSFKSGKKVATITKFKATGKNKDTGVIVPRGALHEQNVYGKIKVIEKDKSLKYLFENSEKIVNPKIKNIVEIILSENENNSKMALSTLKKNPIFLNEEKTDLLEKASCYEYVTVRKYPLNTIKASQADDIVDERVKFLVKERLTQFGNKEKEAFKDTLWFNEEKQIPIITVRLFARPDANNLQAIKKDESGKEIGFVVMGNNHHIAIYEDKDGKLVQHSCTFWHAVERKKYNISTVIKNSSDAWNQFLDNELPEPFLNKLPADNLNLKFSLQQNEMFILGLSQEEFDKALKSNDKSLLSKHLYLVWSISENNYWFRHHLETKNSDLKKTNGVKESKRLYNIRSLGSLFSLNPIKIRLNHLGEITKIGEYS

SEQ ID NO: 830 - protein, 1466 aa, Chryseobacterium sp. Leaf394
MTKNILGLDLGTNSIGWALIKQDFENKQGEILGMGSRIIPMSQDVLGEFGKGNSVSQTAARTDYRGVRRLRKRFLLRRERLHRVLNVLNFLPVHYASQIDFEKRFGKFKEDTEPKLAYNKEGFIFKNSFEEMVADFRKHQPQLLENDKKIPYDWTIYYLRKKALSKKIEKEELAWILLNFNQKRGYYQLRGEEEEENPNKLVEFYSLKITDVLADEPQKGKSDIWYSLILENGWIYRRSSKTPLFDWKEKTRDFIVTTDLNDDGSIKTDKDGNEKRSFRAPSENDWTLVKKKTEQEIDKSQKTVGTYIYETLLQNPKQKIKGKLVCTIERKFYKEELKQILEKQKEFHQELQNDDLYSDCVHELYRTNEAHQLTLSKKEIVNLFMEDLIFYQRPLRSQKTSISNCTLEFRKYKDENGVEHTQFLKAIPKSNPYYQEFRIWQWIFNLNIYKRDDDSNVTKEFLNTTEDFENLFEFLNNRKEVEQKALLKHFKLNEKLHRWNFVEDKKYPCNETKTMISTRLDKVENISKDFFTREIEQKIWHIIYSVNDKIEYEKALKSFAIKHNLDENSFFEAFKKFPPFKSEYGSFSEKAIKKLLPLMRLGKYWNEDEILKYSDDYFKNIESLLGVLKQRDENISDADRENYNKTINNKLRAELENFQNAEIESFQGLRLHIAQYILYGKHSEGDNKKFNSADDLEKFLKEFKQHSLRNPIVEQVITETLRVVKDIWTKYGNGAKDFFDEIHIELGRDMKKTRDERADATKIITENENTNLRIKALLAEMMNDVEMENVRPYSPMQQEILKIYEDGILKSDIEIEDDILKISKTAQPSSSDLKRYKLWLEQKYKSPYTGQIIPLNKLFTPEYEIEHIIPQSRYFDDSFSNKIICESAVNKLKDNYIGLGFIKQFGGTIVECGFGKNVKVFEAEEYEDFVKKHYANNRGKRNKLLLEEIPEKMIERQMNDTRHISKYISGVLSNIVRVEDGSDEGVNSKNIVPGNGKITTQLKQDWGLNDVWNELILPRFERMNQLTNSTDFTAWNENHQKFLPTVPIEFSKGFSKKRIDHRHHALDALIIACATKDHVNLLNNQSAKSDTKRYDLKKKLMKFEKVVYNHPQTGDRIEREVPKQFLKPWDNFTFEAKNNLDKIIVSFKQNLRVINKATNYYEKFVEKDGVKTKERVEQKGTNWAIRKSLHEETVSGKIDLPWVETNNGEFITATRKSLDASFNLEKIKKITDTGIQKILRNYLKAKDDNAELAFSPEGIEDLNKNIEKYNDGKSHQPIVRVRVYEKGKGRFALGQTGNNIDKYVQGSPNLFFAIYKDENGKKSYESIRLDIVIERMKQGLQAVPETNPNGISLYQNLSPLDLVYIPTEDEIESPHLIDFTILNKTRLERIYNVNDFSGYTIYFSQNSFAKNIYPKEMDMTWNEKKQKPSGSFDSKTASYNKKSIKDIFIKLKIDRLGNISKVSNTL

SEQ ID NO: 831 - protein, 1059 aa, Sphingomonas sp. Leaf412
MRRLGLDIGTNSIGWCLTQGPGDEADGIVDIGVRIFSDGRDPQSGTSLAVDRRDARAARRRRDRYIGRRSAFLDTLVAHGLMPADADEAKLVAALDPYTLRARALEAPLTPHEIGRALFHLNQRRGFKSNRKAERKTNDADDGKIATAAYALDRAMLDGGFDTLGQFLNAQETKRVRMDGEAQGYDFYPQRRHVEYEFDRIWTEQAKHHPALLTETARYALHRILFYQRPLKAQVVGKCTFVHSEDRLAKAHPLFQQRRLYEEVNQLEVTTPGEANRKLTLDERDRLVRELSHKKAIAFTSLAAKIKLEPGQSFNKASETRTQLAGDEVRAVLGDKKRFGPAWEHFDRDRQWTIVERLLEEEDPDALHAFLTQDCGLDDEHAAATAKTSLPEGYGRLGATATARILAELQAEVITYDEAVRRCGWHHSDHRTGEILPQLPYYGELLTRDIPPGTQDPNDPPEKRWGRITNPTVHIGLNQVRQLVNAIVAVHGRPDQIVVELARELKLNEKDKEEHNRRIRRDTAAAIKRSEKLTQEGFPDTGANRMLLRLWEDLNPANPLDRRCPYCGAPIGMRALFAGEADVDHIIPYSRSLDDSAGNKVVAHRSCNRAKGNRTPYEKWSDDPDRWDAITAQVARLHRSKQWRFGPDAMARVEKDGGFLSRQLTDTQYLSRLAGRYLSSLYPTKEEGSVYVIPGRMTAMLRRLWGLNDILSDHNIVENKHSNAPKNRLDHRHHAIDAAVVAVSTRSLMQRIARTAGQAEDRNLDRLFEGLDPPWPGFRDQLRDRLLAVTVSHKADHGRTGTPVPGKDATAGRLHNDTAYGLTGETSAKGLPIVVHRVPLTSLKPADITDPDRIPDPVLRDAIERATAGKMGKDFTDALAKFGRSGAQETDRKGERLFRGTRRVRVREPLGVIPIADASGRVYKAYKGDSNARFDVWRLPDGKWVSDIVSMFDAHRPDQGDRRPHPAAKKVLSLRQNDMIAIERDGAPREIVRVVKFSTIGSVQLAATTEAGPLKARDASPPDVDPFRYINSSAGGLKKIKARQVRIDPLGRIFDPGPR

SEQ ID NO: 832 - protein, 1384 aa, Unknown
  JGI_JBU_contig0001800012:543301590957_19
MTQVKDDYMVGLDIGTNSCGWVATDFQNNILRLHGKNAIGSHLFEEGHSAADRRMFRTTRRRIKRRRWRLNLLEEIFDPYIANVDPYFFARLKASGLSPKDSSKKYESIVFPTIEEDKSFYQKYPTVYHLRKALMNENKKFDLREIFIAIHQIIKYRGNFLQDTPISDFNASSIDVKNVLDILNEQYASLMPEYQISFSIENAKEIEKIIRDQTIFKQDKQKKISKLLPIVTKNKANSKISKDVAKQIANAILGYKTKFETLLLNEIDKNDKANWEFKLGDADADNKLELLLSSLNEAQQNIILEIKELFSAITLSEIVDEGKTLSESMVRKYEDHKHDLKLLKRVINNLSDRQKGKRLSLAYDLYVNNRHGKLLDAKKTLGKKGCLSKEDFYAEVEKNLDDSKESGLILNKINLDSFMPKQRTNENGVIPFQLHQIELDKIISNQGKYYPFLKEINPVASHRNQAPYKLDELVRFRVPYYVGPMIAPEKTKDKQKQANQSFAWMVRKEPGKITPWNFDQKVDRMASANKFIKRMTTKDTYLLGEDVLPANSLLYQKFTVLNELNNIRINGKKIPVDCKQQIFDKLFKNNSLVTTKKLITFLKENYKLVSVDIRGLADDKKFNSGLTTYNRLKHTQLFNQQIDNPKFRADLEQIIEWSTIFEDKRIYKAKLETVDWLNEKQMNILTNIRFQGWGRLSKKLLVNLHDSNGQNILEKLWDSQDNFMQIINEADFKEVITEANQSQMQSSTMEDILADAYTSPANKKAIRQVMKVVNDIKKAASSKDPKQIAIEFAREPEANPQITHVRGSRLQEIYKSLSENIVSKSIKNELDRAVKNKRLAKDKFFLYFMQLGRDAYTGKPINIDEIENGYQLDHILPQSFIKDDSLDNRVLVSSPVNNGKSDNVPIEMFGNRQAANLGMTIRQMWDNWKDLGVISKRKWNNLLLDPKHINKYQSSGFIHRQLVETSQIIKLVSTILQAEYPNTEIIVVKASSNHYLRKQLNLYKSREVNDYHHAIDAYLTAICGNLLYQVYPNLRPFFVYGKYKRFSTNPDEENEIFKHVRRFDFIARLFGKNSLNNITAGKNGPIVFKRDTIINQLHHAYEYKYMIVSTETTTRDQEMFNMTIYPRAERDIKKTRSLIPKGKGLSVAIYGGYSGNSDAYMALVKVNKAKESEYRIIGVPMRALSLLRSSNNSKETLHQILEPKVFLNKKGKRKTAVKSFEILRERVPYKQVIVDGDKKFMVGSSTYVYNAKQLTLSNNAVKTITENINDDNNATKNLDHTYDEILGVLDKYLSLFDINKFREKLHNGRNKFMALSDMEKQNTLREILKGLHDNPVTGNLKNIGLSTPLGQMQIKSGILLSPEAKLIYQSPTGLFEKRVKISNL

SEQ ID NO: 833 - protein, 1093 aa, Carnobacterium sp. ZWU0011
MSDLVLGLDIGISSVGWGIINEKTGEVIDAGVRLFEEATRNANEDRRNFRSSRRLKRRRKHRLERVNSLLNENGFSCASIQQVDPYMARKNALYQKVSKKDLAAALYHLAKRRGTTLDTPQEDEKTSGSELSTKEQLKKNAKKLETKHIAEVQLEKRQSGEVIRNHTNRFKTSDYVKEAIDILAKQKEYYPEITNTFIKEYISLLESRRMYYDGPGSKKSPTPYGQYFIGEDGNLHHETMINKMRGRCTYLPEELRIAKMAYTADLFNLLNDLNNLQYPDKETGEMEHLSEEDKHHFVDNFVKKGKRVTLTAIAKYLDVEDEKLIRGVRVDLKSGKAIFTDFVGYKKLLKLLKDIPTPEDFFDQIDVLDDIAEILTAEKSLTRREEQLTDLFQKTYQDDLKEVTEALINDTSFKEYHALSKKAMQIIMPELWETSKNQMQLFTEHGFGKSRMEKLQSGSNIQFDDEAILSTVAKRAHREAIKVTNAVRKKYGEMAYVVVEMAREKNSDEERKKIAEVQRNQGKFEKKICDLLEVDNLKDLRLNGKQHLALKLWDAQDGKCAYSGESIALSDIVYDFTQFEVDHIIPLSYSFDDSQQNKVLVYRDENQLKGQLTPFQYFQSGKASRSFEEFKVESLNLFKSHKISNKKLGYLLEQRDIQHDEEVQKDFINRNLVDTQYAMRSFSNSLRIFYQNHDIPTKVLSIRGSFTAALRRRTKMHKDRDAGHFHHAIDALIVAAIGRMPVFEQLKGSTFNDEGVAVDTDTGEILEAGNLFDNQSLKFISQLRHYENKVKYSHKVDRKPNRTMSNQTIYSTREKDNEKYIVGKVKNIYQLDKKGYDALKKRIDKNPDLFLMAQHDPKTWELVLKVMEEHQHADNPFQDFYKEHGYILKDGKVPVKNLKYLDRKLGIHVDITDKYADAKNDVVLLSRKSIRVDIYKNDEDKYKYLGVPYNWFKKIDGVYTLDMDLYNGKDGRNAPYKQIDDSYEFQFSLYKNDVISYDKMETLKDEVTGKKTKKMFHYEKLFRGDAMPRDNKIEIENVDLKTPKQQFLAISTLNNFYKYNTDILGNLYLLKKETFSPYLNNDSLSKKVLEKMS

SEQ ID NO: 834 - protein, 1352 aa, Lactobacillus brevis
MDKEPYGIGLDIGTSSIGWSVVDMNGRIKRVKGQTGLGVRLFEEGQAAAERRGYRTTRRRLSRRRWRLRLLREIFDEPISAIDASFFARQKASNVSPKDTKFVTTYRLFSDQSDGEFYEKYPTIYHLRQALMTEHRQFDLREIYLAIHHIVKYRGNFLRSGNPQKFQPGKLDFNERFTRINQAWLGVFDELAPQLPEEDLEDVTAIILDTTRSRLDRQRDLVKQLMKMTGNQKSWKPILTAFCKAILGLKAQVYLVLGLDVAKEDQKSLTFSLADIEDHRDDLAALMDEKQTALLEKLVDLQAAIQLTEIMPDGKGFSESMVQSYVNHKEHLCWLKEYATVQTDEQRRTKVLLAYDHYIDGNDKGKAETTGDFYNELRRLLKGDTSELAQKMMNAIELEKFMPKQRTKGNGVIPYQVHQQELDAIIENQKDYYPFLAAPNPVVEDRREQPYKLDELVHFRVPYYVGPMITAEEQAKTAAGQFAWMVRKESGDITVWNFDKKVDRVASATNFIARMKTTDTYLIGEDVLPLQSLIYQRFMVLNELNGIRVNGERLRRDQKQRLYNQVFKTRRTVSIKAIQKNLVNHGDVDKRPVIEGLADPKNFNSSLSTYQDLKAILSTAVDDPKRQVDIEKIVNWSTVFEDQRIFKDKLQEIGWLTDTQRNRLSAKRYRGWGRLSARLLTEIQDAQGQSIMDQLWQTQHTFMQIVHEPDYAAAITAINAAGFKDRTLETTIDELYTSPQNKKALRQIVAVVRDIQAARHGQVPSRIFIEAARGAMDNNPQRTRRRQKQLTDLFADRAKEIVSQTVTEELKDQIADKAKFTDRLLLYFLQNGRDMYTGEKLNIDRLSQYDIDHILPQSLIKDDSLDNRVLVQQRINRDKNDSFAADLYASKMQGTWELWRSAGLVSARKLRHLLMRADEINKYATGFVNRQLVETRQVIKLTTDVLSSLYDPEKTQLISVKAALSHQLRTELKLPKLRELNDYHHALDAYLAARIGTYLLKRYPKLERFFVYGQYKVAPQLDLRHFNFIHDLVSDKQVIDPDTGELLWDREADIKYLEHLNGLKHLLVTHEVFEDHGALFDQTIYPARKAQNKKLIPTKQGRDTAIYGGYSGQNTAYLAIVKVHDKVDYLKVMAVPIRVVSEVNQLRKLGLAAEKAYLKKLFLPQFTKKSGTIDFEVVRPHVYLQQRIEDEVYGEVHQFALRSSTYYRNLQQLWLPLSSQQVLLKKDAKDGELTRVFDQICEQAQRYFSLYERNNFRQALQNSRSQFVALPTTNVIDDHGKLVQVGKREIISRLMRGLHANAERKDLKVIGIKTSFGLLQEGNGIRLGLAAKMIMESPTGLFKREVRIDPES

SEQ ID NO: 835 - protein, 1016 aa, Unknown
  JGI_MagWD_c19:4851378969_17
MAGEVSLGIDLGIGSCGWALVAEDSLVALGTRTFDVPETDKERTPTNQLRRVARGMRRVIRRRRQRMNDIRALLHRHGLLTDECKSALADRLDPWLLRAEGLDRRLSPRELALALGHIAKHRGFKSNSKRDRGANAPDESSKMLAAAAKLREKEGAWRSVAETFLNDPELQGRRRNRDGLYDRSVLREDLEREVHTLLHAQRALGNPHASETLEADFVKTAFFQKALADSEDKVGFCPLEPAEKRAARPSPSFEMFRLLARLTSLRIDGVPLSAEQIAAATHDFGHQQGITFARLRKLLALPPTARFDGTAPEDEGKRDVVARSGKAMPGSAALFKVLGEAGWDSLRKRPDILDRVAAVLTFREDVNSIRAGLAELALDAPILDVLMAGVADGAFAAFRGAGHISAKACRALIPHLAQGKVYSDACTAAGYTHSDQPETDLDSIANPVARKALGEALKQVNAIIRAHGRPAAIHVELAREVGKSAEERAEIERGIDKRNRQKDKLRQQYRDTVGGDPNAEDLLRFELWKEQGGRSLYSDRDIPPALIASGRNEVQVDHILPWSRSGDDSFINKTLCFTEENQRKKGRTPREWFDQDGLDWSAFAARVENSKEMKGRKKRNYLLKDASVLDEKFKSRNLGDTRYACRLLLNILKKTYPDITVAARPGPLTDRLRRAWGLQGLKKDAEGKRVEDDRHHALDAVVVALTSQSMLQRLTNLFQEAEARGLPTNWHGIGHLRDLLHDSGGVPRTFDALEPPWPGFRAEIIAALDGITVSRAERRRARGAGHAATIRQVSERDGEPVVFERKSIETLTEKDLERIKDAERNHRTIDALRAWIAAGKPKDAPPVSPQGHVMRKVRLSTNKKVDVPVRGGAADRGDMARVDVFRKANRKGKWEYYLVPVYPHEVATLAEPPYQAISRGDEVLDTRVGFDFLWSLYPLCWVEVVKPSGEVIEGYFRGMDRSTGAIAISPQHTKAETAKGIGVKTLASFRKFAVDRLGNRSEIQQETRTWHGKVCT

SEQ ID NO: 836 - protein, 1331 aa, Lactobacillus sanfranciscensis
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 837 - protein, 1147 aa, Unknown
  JGI_RPDSM127_DSM127_contig_337.337:3196173780_22
MLQKSSKPYRLGLDLGSNSLGWFVTYLERRGERYEPISLGPGGVRIFPDGRNPQSKASNAVNRRMARGARKRRDRFVERRKQLMEALARHGLMPADAASRKAIATLDPYALRAKALVDALPAHHVGRALFHLNQRRGFLSNRKTDNKKNGEDGAIKQAASRLRDSMVSEKAPTLGVFFASKHLSKEYAERQDAVRAELKRTGKDHLTGNARKKAWAKARKRLFSDEVLDPAGAPDGIRARATITGTKASYDFYPTRDLLVHEFNAIWTAQAPHHPTMTEDARKEIERIIFFQRPLKDPIVGKCTLDPATQSFEDDPEGYRAPWAHPLAQRFRILSDARNLEIREVGKGSRKLTKEQSDAVALALLGSKEVKFDKLRTLLKLPDEAKFNLESDRRAALDGDATAARLSDKNGFGKVWRGLPLERQIAIVEKLLAAEIEAELVDWLERECELGPQAAARVAHTMLPEGHCRLGLRAMKAIVPIMQNELADDGVAGAGYYEAAKRAGYDHAKLPTGEQLDHLPYYGRWLADAVVGSGDARDGKERQFGQFPNPTVHIGLGQLRRLTNRLIRNYGPPAEISIEFTRALKLSEEQKAEVQREQRKNQEKNRARAAELEKLGFPANPRNLLKMRLWEELNFRDPLDRKCVYTGEQISVQRLLSDEVDIDHILPVAMTLDDSAANKIVCMRYANRHKRKQTPVEAFGSSPTFQGHRYDWNEIAARAAALPRNKRWRFDADAREQFDKRGGFLARQLNETGWLARLAKQYLGAVTDPNHIWVVPGRLTSMLRGKWGLNALLPDHNYAGVQDKAEEFLASTDDMEFSGVKNRADHRHHAIDGLVAALTDRSLLWKMANAYDEEREKFVIEPPWATMRDDLDAALKKMVVSHKPDHGVQGKLHEDSAYGLLKQPESIDDDDKDGANLVYRKPIEGLNENEIGRIRDRRLRDLVREHVETEKKKGVALADALRKLKEPSGNPHFKHGLRHVRLLKKENTDYLVPIADRTTGKPYKAYSAGENFCVEVFETADGKWDGEAIRRFDANKKNAGPKAPHRPRWHTENPGARLVMRIHKGDLIRLDHDGQVKIMVVHRLDAAAGRFKLAAHNETGNLDKRHSTDNDVDPFRWLMASYGTLKKMSAVPIRVDELGRAWRITPR

SEQ ID NO: 838 - protein, 1147 aa, Unknown
  JGI_RPRCH350_RCH350_contig_254.254:455839144_11
MLERHPQRYRLGLDLGSNSLGWFVTNLQQRGDRFEPVGLGPGGVRIFPDGRDPQSKASNAVDRRMARGARKRRDRFVQRRSQLMDALVRHGLMPEEAAARKALAGLDPYQLRARALVDRLPAHHVGRALFHLNQRRGFLSNRKTDNKKNSEDGAIKQAASRLRDSMASQGAETLGEFFAGRRHSDTYAERQTAIRAELQRIGKDHLTGNARKKAWAKVRKRLFGDDVLDPAMAPEGVRARAIITGTKASYDFYPTRDLLLQEFHAIWRAQAPHHSTMTESACREIERIIFYQRPLKDPIVGKCSLDPATRPFKEDPEGYRAPWAHPLAQRFRILSEARNLEIRETGRGSRKLTKAQSDVVALALLGSKEVKFDKLRTLLKLPAESKFNLESDRRAALDGDATAARLSDKNGFGKAWRGFPLERQVAIVERLMTVEVEAELVDWLEQECGLGPEAAARVANTSLPEGHCRLGLRAIKKIVPVMQNEVGDDGVSGAGYYEAAKRIGYDHAKLPTGGDLDYLPYYGKWLADAVVGSGDARDGKERQFGQFPNPTVHIGLGQLRRLVNELIRAYGPPTEISIEFTRALRLSEDQKAQVQREQRKNQDRNRARAAELEQLGFPANPRNLLKMRLWEELNLRDPLDRKCVYTGEQISIERLLSEEVDIDHILPVAMTLDDSAANKIVCMRYANRHKRKQTPFEAFGSSPLVQGRRYAWDDIATRAAALPRNKRWRFDADAREQFDKRGGFLARQLNETGWLARLAKEYLGAVTDPNRIWVVPGRLTGLLRGKWGLNALLPDHNYAGVQDKAEAFLASTDDMEFSGVKNRADHRHHAIDGLVAALTDRSLLWKMANAYDDEREKFVVELPWPTMRDDLKAALDKMVVSHKPDHGVQGKLHEDSAYGLLDRPEPVEDDDREPANLVYRKAVETLSENEIGRIRDRRLRDLVRDHVDAAKRNGVALADALRQLTEPSDNPHFRHGLRHVRLLKKEKTDYLVPVVDRATGRPYKAYSAGENFCVEVFETADGKWSGEAVRRFDANRSNCGPKTPHVPRWRTESAGARLVMRIHKGDLIRLEHEGRTRIMVVHRLDAAAGRFKLAAHNETGNLDKRHATDNDIDPFRWLMASYGTLKKMAAVPVRVDELGRVWRIDPR

SEQ ID NO: 839 - protein, 1339 aa, Unknown
  JGI_TM7x2Draft_NODEunique_6_len_24568.8:139977_3
MKQPYSIGLDIGTNSVGWAVINESFDLRKYKHQNMWGAHLFDEAQKAATRRSFRSSRRRLARRKRRITLLQRIFDNEMQKVDPHFYLRLSESMLHLGDKNSALELDANILFADHSFTDKSYREKYPTIYHLRRDLFHNSKKQDIRLVYLALHHIIKYRGNFLVEGGVDNVISSFDNQNLQKFMDFIGADESIAKKVKAILLDRSLSRSVRKSDIISLLQPSSDKKRAVSEAVGAVIGLKWNANKLFEDDSLEAKGEFSNKNYEEQRDEIAAAIGDDRYELVETLESVYQWTIFSQFIRKDSCLSDIMVEKYDAYRQDLSDLKALFHEFLPQKYKTFFHGDAAEFELYNNHKRNLDDLYKSIKKQLGEVAKDDPRYQRFEKRAELEEFLSRQRIRDNGAIPHQIHQYELEKIIDNQAQYYPFLAQNRDKIISIFTFKLPYYIGPLKTGGNFAWSVKKKDGVIYPWNFDEMIDDEASAEKFIDRMRNNCTYLPDEEVLPKNSLLYQEYEVRNELKSVTVNGERLSPDIQNRIVDELFTKELSVTYKKFIKYLYDNQIYNTDSLIISGTAKEKSFASSRKSYIDFMQKVGVSITPKNQQAIEEVIKWITLFEDKKILAKKLQKHSDIFNENQLRTILKLNYSGWGRLSRKLLDGITAHTPYGELTVIETMRSSKDNFMQIIQSNRYEFKKIIDDILSADQRTDIAYDDIKKLAGSPGIKRALWRSVRIIDEIVDTIGYEPKLISIEMARNEDEKVRTKSRYSQLEKMYKELYGKEYTKSDIKSQLADYKDKLDRKKYYLYFLQNGKCAYTGEPLDIENDLRDSEIDHISPRSLTKDDSLDNTVLVLRKENQRKLDDYPISPDIQNHMRPIWISLKNAKLMSQIKFQRLASQKQLSEDRVAGFVNRQLVETRQITKHLARMLTEKYHNSSTEVFTIRAGMSSEYRRIHDLPKCREVNDLHHAKDAYLAATLAQYIKIRYPKLDNAFIYGEYMKFKSRRQTDTDRSSFILASMNYDFTDINTGEIIWQSKTAHNVIDRTMKYNDCLTTKKTEIGDNQFYDQTIYGKDSGVTMITRKANLPVDKYGGYSGRKAAYFMAIRYLKQVRNKDVFVNEIISVPTQVYTLEKTKPGSINEYLRKNYRQVIVLVPKIPINQKIEYDGNEQFIVGSSEVTNAKQLKLPYGIEYAIAIVLKQGIPHVTISEEQAADDNKLQRKRNRQIEKRDRAISGVEKFWGIYAEKLANQYQQFGNAGNSARNTLAEYTKLSLDDKIKVIGLVLRATHAGSDRVDMKGSEKKPVFPELGLPNSFGRMAGKSLDPTKLTFVYESITGLHRRKLDGKTLGQDR

SEQ ID NO: 840 - protein, 1004 aa, Unknown
  JGI_Zagb111MP_Contig_1986.13:475535210_9
MSKKVFAFDMGKASIGYCAREDNEIKEANSIIIDREHSDISSLRDRRRVKKTLDAHKAREKFFIKVWTDCGLVPLDTNSAEFKKEFSAKNDQTIYTSCLLRIVLLQNKKLEQWQIFKALYNAIQRRGYDPNLAWKSAQSEDDKENLELIQKYTQENDIELIANDDYKYPCYYDAIRLGLWCENKPDEFERTVNQQSLIKVRTTSYVAPRQLIEKELKQLWINAQKQLSELNKYSVEEFLYGEYEEAYGSYVNPDYKKYMGTEHDWQGVLGQKIPRFDNRIIAKCKLLPKRNVCKANTLENVSFVLLMKLKNLRLTMLNGRKKKLDPSEIKKIYDNWLQESNNGKILTTTITKTKIEKVLGEKISAETKTLNDDLKVNISGRSSFCKRACKIMNKFILSGELYPLDMDITEFLDPEDCPNRITEEEIRSMLSKIGDWNKLYIPDNRGENISDEELTRVKTDLMIGDITNPIVRNRLQIFRDLLLYLEKKYGKPDEVIFEFVREGADNSLFGRAKAQAAETNMKIMEKNNQLIVNELNAADAYSAVNFEKLKLLKMQAGRCVYSGDNICVEDFDKCEIDHIFPRTMGGNDALYNKVLCFRVENQDKRGRTPYEWLSSDEDKWANYVKRLNDIKGSLGKKKFELLTSKPEDCAKLIESYNGLAETSHIARVAQQITAFVFGWGLQVEGEKRHIFVNNGSSTHAIRKRYGLNSLLGNDTKKNRDNDKHHALDAICISYSRDFKYDEKSKKDIIKGFTREMVKKVIEEIIPYPYTNKKPFKGNVRPLETIYGLRTYGDKSYITQRVSLEDIEQKDKKIKSIVDEVIKNDLMEKLSQKMDSKDWVNMLQNYIHPKKKTRVKKVMIVVSEGEIEKDNNDRERIGRYCDFGTKGTKHQFKRSKGHKGQILYFNEKGAVKIMPVYANIKTQDIKDKLLALGCKLYRNGEMFYSGCLIDILNEFNVGNITYPPGTYKLRTIEEVGTTKIETNNGIELRFNIKNLVRANFKRNWS

SEQ ID NO: 841 - protein, 1330 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSDQMDTLLDDPDMTTMFEEIIKILTIFEDREMIREQLKPYETVLGLPAIKKLAKKHYTGWGRLSEKMIQGMREKQSRKTILDYLIDDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASHQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGERL

SEQ ID NO: 842 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSLEQKEYILAELMTKEFTRFGVNDVVKLLGVKKERLSGWRLDKKGKPEIHTLKAYRNWRKIFAEAGIDLATLPTETIDCLAKVLTLNTEREGIENTLAFELPKLAEPVKSLVLDHYKELSQSISTQAWHRFSLKTLHLLIPELMNATSEQNTLLEQFQLKSGVRTRYSEYNKLPTKDVLAEIYNPTVNKTVSQAFKVMDALLEKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKTNGKFSNWDDYQKWVESRHFSHKKENNLLETRNIFDSEQVEKFLARNLNDTRYASRLVLNTLQSFFANQGTKVRVVNGSFTHTLRKKWGADLDKTRETHHHHAVDATLCAVTPFVKVSRYHYAVKEETGEKVMREIDFETGEIVDEMSYQEFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 843 - protein, 1464 aa, Unknown
  Locus24
MAKILGLDLGTNSIGWAIVDKDGNDFSLVDKGVRIFSEGVKSEKGIESSRAAERTGYRSARKIKYRRKLRKYETLKVLSSNGMCPLSVEEVEDWKKSGFKKYPLNPEFLKWLRTDEYQHINPYYFRDRASKQKVALFELGRALYHIAQRRGFLSNRLDQSAEGVFEEHNPQIQSLIEDLDDSKLILDELKNYYVDKGIIEEAEKGVFKKDLDEGEKKLKSLYNSLVGIIKKNENNVEKCKEEFIARLNKKEDLGKVKGKIKDISQAMLDGNFKTLGQYFFSLYNKGKIRNQYTSREEHYLEEFITICKIQGIEGIDDKEKLPEKKFTGLAKDLYKAIFFQRPLKSQKGLIGKCSFEKSKSRCAVSHPDFEEYRMWTYLNTIKIGTQSEKTLRFLTQDEKLKLVPKFYRKNDFNFEVLAKELVEKGASFGFYKSSKKNDFFYWFNYKPTDSVAACQVSASLKNVIGEDWKTKIFTYKTLNAKEEEVTKSVDYKDLWHLLSVATSDIYLEEYAKDKLGFDDKNAKAFSKIKLKKDFASLSSSAITKILPYVKEGLLYSHAVFMANIENIVDENIWNNLDQRNYIQSKIAEIIEGYTFEKTGLEVVNSLIKEYKTENDYSKKVYYSKEAEPEFEKDLKQKLVVFYKSNDIEDENIKQAIFNDLYSVLIDQLKKYEYIKIQRLDEKVLEFLKGENEDGEVFCNNPKQLKKLYHPSDIEIFKKQKVKDKDGKETGQLILGSPLTSSIKNPMAMRALHQLRKVLNTLILEGQVDESTRIHIEMARELNDANRRKGIQDYQKENKDFRDNAIKEIKKLYLDECGKEVEPTEDDILRYQLWIEQDKCEIYEQGKNISICDIIGSNPAYDIEHTIPRSISQDNSQMNKTLCSQRFNRDVKKQKMPIELSNHLEILPRIAHWKEEADNLSREIEIISRSIKAASTKEIKDKKIRRRHYLTLKRDYLQGKYDRFIWKEPKVGFKNSQIPDTGIITKYAQAYLKSYFKRVESVKGGMVAEFRKQWGIQESFIDENGFKQYKEKDRSKHTHHTIDAITIACMTKDKYDVLAKAWTSEDEQDKLKAKALMADAKPWKTFKEDLLKIEDEILVSHYTPDNVKKQSKKIIRVRGKKQFIAEIERDVKGKAIQKKDANGKVVYKLNDKGEKIPRLQQGDTIRGSLHQDSIYGAIKNPLNTDEIRYVIRKDLESLKASDIENIVDETVKEKVKQAVTNKVLLLSSNAQQKNKIAENEKVWMNKEKQISINKVRIYANSVKNPLEIKEHSLLSKSRHEHKQRVYGQNDENYAMALYELDGKREFELINNFNLAKLIKNGQGFYPLNKEKELKGKKVLYPIAKSNSRDVVLKRGQQVVFFDKEVEKPKDISEILDFKRRVYIIEGLSIQRIKSGNNEFEYGVIMLRYFKEARKSDEIKKDNFKPDGVFKLGENKPTRKMNHSQFTAFVEGIDFKVLPSGKFVKI

SEQ ID NO: 844 - protein, 1458 aa, Unknown
  Locus 25
MAKILGLDLGTNSIGWAIVDKDENNFSLVDKGVRIFSEGVKSEKGIESSRAAERTGFRSARKIKYRRKLRKYETLKVLSSNGMCPLSIEEVEDWKKSGFKQYPLNPEFLKWLRTDEAENINPYFFRDKASKQKVPLFELGRAFYHIAQRRGFLSNRLDQSAEGILEEHCPKIETIVEDLNSYEEVLENLKDYFFFETGILDANEKSGYAKDLDEGDKKLVSLYKSLHTIVKKNDTNFEKGKAEIIERLNKKDVLGKVKGKIKDISQAMVDGSFKTLGQYFFSLYSKEKIRNQYTSREEHYLEEFITICKVQGIDSINEKEQLPEKKSDGLAKDLYKAIFFQRPLKSQKGLIGKCSFEKSKSRCSVSHPDFEEYRMWNYINTIKIGTQSEKTLRFLTQEEKLKLVPKFYRKNDFNFEVLAKELIEKGTSFGFYKSSKKNDYFYWFNFKPTDSVSACQVSASLKNIIGEDWKTKTFTYQTLNVKKEEVTKTVDYKDLWHLLSVATSDIYLNKYAKDKLGFEDKNAKAFSKIKLKKDFGNLSLSAITKILPYIKEGLLYSHAVFMANIENIVDEEIWKDEHQRKYIQTQIAEIVENYTFEKSQLEVINGLIKDSKLKEEYYSKEAESIYKKDLATKLVLFFKYNVIENESDQKIIFENLFPIFIEQLKKYEFIKIQRLDEKVLEFLKGENQDGEIFCSNPKQLKKLYHPSDIEVFKKKIIKDEFGNEKVVLGTPLTSAIKNPMAMRALHQLRKVLNTLILEGLVDENTLIHIEMARELNDANKRKGIQDYQNENKKFREDAIKEIKKLYLDECKKEVEPTEDDILRYQLWIEQNRQEIYEQGKNISICDIIGSNPAYDIEHTIPRSRSQDNSQMNKTLCSQRFNREIKGNKMPIELNNHLEILPRIAHWKEEASNLSREIEIISRSIKAAATKEVKDKKIRRRHYLTLKRDYLQGKYDRFILEEPRVGFKNSQIPDTGIITKYSQAYLKSYFKRVESVKGGMVAEFRKQWGIQESFIDENGFKHYKIKDRSKHTHHTIDAITIACMTKDKYDVLAHAWALEDEQNKKEAKAIIEKAKPWKTFKEDLLKIEEEILVSHYTPDNVKKQSKKVIRIRGKKQHVAEIERDEKGKAIPKKDANGKILYKLDKEGKKLPRYQQGDAIRGSLHQDSIYGAIKNPLNTEEIRYVIRKDLESLKASDIENIVDETVKEKIKEAVANKVLLFSSNAQQKNKIRENEKVWMNEEKQVPINKVRIYANSVKNPLEVKEHSLLSKSRHEHKQKVYGQNDENYCMAIYELEGKREFELINNFNLAKLIKGGQGFYPFYKEKEVKGKVVQVPIAKRNGRDLILKRGQQVIFYDKDVENPDDVFDLVDLKGRIYIIEGLSIQRQVVSGKLYEFGSIMFRYFKEARKADEIKKDSFKPDGTFKSGEIKPTRKMNHNQFTAFVEGIDFKVLPSGKFIKI

SEQ ID NO: 845 - protein, 1127 aa, Unknown
  Locus 26
MAKILGLDLGTNSIGWALIDDKLNKILGIGSRIFPMGVENLGDGDNEMSKNASRTGARGVRRQFFRRRLRKKVLLKSLSENNMCPINTKDFEDWKQTKQFPNEKLATWFAMNPYELRQKALTEKLSLEEIGRIFYHLIQRRGFLSNSRKGGSDDGAIFKGNAKEGKIGIDYTLESIEGKTLGSYLYEIYPKENQPFQYGLERIRNRYTTRRMYIDEFEMIWNKQSEFHSVLNYDLKTILGGRKQDNYTEDGILFYQRPLRSQKHLVGNCSFEPLKTKCPISAIPVEMFRIWQWVNTVEYNGKKISEEEKTKLVEQLLSFDKIEFKKLRKAIGKESAEFKFNYKDDDKIAGTHTISNLSNRKFFGKRWFDFSDKEQEDIWHVLYFFDSKSNLKEYAVKNWNFSEEQAIAISRFNVKDGYASLSRKAIGNILPFLQQGYTYDIAVVMGGIKNAFGDKWQNDTVENKLKQLDLIDNIEGIVRSKISGGFIDTIKDLLRKEFEFNDKQLKKLYHHSAAIDTVALLRKLPTGKQADKDIQAIRNPIVITALFELRKLVNELIEEHGQLDEIKVEMARDLKISKSQRNKIRKDQKRLERENDRVKKEVEKYVRVSHDNILRFKLWEECKQTCPYTGVVIPVTKLFTGEIQIEHIHPWSRSLNDSFNNKTLCYADENRRKGDKTPFEFYGSDELDWIARKERALKLFSDTKEYPNAYQKFKRFVQQKFDDDFSSRQLNDTRFISKEASSYLKQICEKVNVSPGQMTANLRQKWGLNTVLNDENAKTREDHRHHAIDALVMACGKTSYLQELSKWNRYNRNYDLKDFPMPWETFRFDAEKAIDKILISHKRISNDITTRYTKVEKNGKTYINKGVAARGQLHKETVFGKRNFNGDEAFHVRKSIDSLTTEKQLEKVVDEVIKKLIHKKIKELGGFVKGTIPANTFFNVDENGVKQPQIFLPNKNGSPVPILKVRMKENISGAEKLKDNVNQWVNPRNNHHVLIYKDEKGILREEVVTFWTVVERKSKGFPVYQLPVEGKEIVTALHINDMFLLGLNEEEINWENPDYEILRDSLYRVQSLSSKYYEFRQSINAESQNKISPIYEQIRGFGSGKTGWDSFNPIKVKISVSGKISKI

SEQ ID NO: 846 - protein, 1108 aa, Unknown
  Locus 27
MAYKLGIDLGTASIGAVAIRIENNEPQSIDWHAVRIYSEPVVNTPKGLQPKKAARRDARQLRKQIERRARRLRRIANLIPLLGLHKAEVKPGRRQDLTTLRAIAARQQVELNEFALVLLRLAKRRGYAGGFRDSKDGVVKSSSDKLSEEMRRLAETQNLQEITLGEYLLYRQEHGLPVWLKAERPGLEPRYALREMVTAEFEQLWTTQARYHPILASNHLGKPLKQWFNEALFYQRPLKSPAHMVGNCLLEPNLPRAPRAHMAAQHFRIDKTLHDMRWGSGRRAERLSKAQLNVLRQMLNDPANADGKVSFKHLYQALSETGLSDPRSRTLNLERSSCDQLSGNNTVARWRALGLYDQWLTLAPRDQTTIINLLADLGGPELLVPDDWHQNIRKSSAKAGDTNLYRRFRPEVVDFINALRECKDNNGQPVFNRLTSMKFEGGRSSYSVKALEKLNTWFNDPWWPDEGSGAERGDEIDEDAALRVCYPHLFTQPQELLQRLEAAPTTGNDVVDGALRELRKVINQCIDALGERPEEIVVEMAREIGKGVVWRKEQENRIRQNELARRKIASELEKHGLSANNTRILRYQLWEEQDLHWCPYCAHPINLEAATSGMTHIEHVLPRSLTQIGRKRSELVLAHAGCNNLKADQTPWQAFGHDVERWSAVERAAARFQELGKKSYAKDRIKAMGFYRKAELLLLKDYESEVLSDESIADFADRQLHQTSWIAKAAAQWLRTITPLVSVSRGEFTALLRHQWRLDTVIAEARLDEKLPVLDIDACPVSPEAFQQFRKQWEGHPPDNLAERTERKLEKRLDHRHHGIDALVIALTSRSLYMSLARRYVEESERRARGERVRHDWSIEPTMHNLRNQALGMVRTCNLTHKPDRNPAGRLFKDTAYGVHFPEEGDRVQLTLRKPLTSLADEKSAEKTRKNLHSIASSEVRLLVLKAFEARLSVGQNPKQALSEPVPYPAYGTAIWRVRCMQGYADDAVRIVHKSRQGEHEKHLLNDGYACLEITAGENGKHQVRLVTQREAQGRGFMDNRQQAKRIFKGDTVIDRRDDRKYLVGYFKAEGYIFLLPHTDTRNFDKIKEADSGKKKVSFNQAYQLERI

SEQ ID NO: 847 - protein, 1108 aa, Unknown
  Locus 28
MAYKLGIDLGTASIGAVAIRIENKVPISVDWHAVRIFSEPVVNTQKGLTPKKTARREARQLRKQVERRARRLRRIANLIPLLGLQKAEVKLGRRQDLTTLRAIAAREKVELHEFALVLLRIAKRRGYAGGFRDSEGGVVKTASDKLSVEMRALAETRGLQQITLGEYLLHRQQRGLPIWLKAERPGLEPLYALREMVTAEFEQIWTIQAKCHPILNSCHLEKPLKQWFYQALFYQRPLKSPAHMVGNCLLEPNLPRAPRAQMAAQRFRIEKTLHDLRWGGGRQAERLNTAQLDLLRQTLSDPTNVDSKVSFKRLYQALNEAGLNDPRNRTLNLERSSRDQLLGNSTVARWRALGLQDQWLMLAPRDQTSVINLLADLGGPEILTPDDWHQNIRKSSAKDDNTKAYRRFRQEVIDFIDALRRCIDSNGQPVFNRLSAMKFDGGRSSYSVKALEKMNEWFNNPWWPNEGPGSERRGEIDEEVAIRVCYPHLYTQSQELHPRLEAAPTTGNDVVDGALRELRKVINQCIDEQGEKPQEIIIELAREVGKGVALRNEQESRIRNNELARRKIASELEGHGLIASSTRILRYQLWEEQERHWCPYCALPISLEAAISNMTHIEHVLPRSLTQVGRKRSELVLAHAGCNHLKADQTPWQAFGHDAERWSAVERAAARFQELGKKCYFKDRAKAMGCFRKSALLMLKDYESEVLNDESIAGFANRQLHQTSWIAKVAAQWLRTISPLISVSRGEFTALLRHQWRLDTVIAETRYGEKLPVLDIDGNPVHPEEFQHFRKQWEGHPPDNPAERTERKLEKRFDHRHHGIDALVIALTSRSLYMSLARRYVEESKKRARGEKVRRDWSIEPPMHNLRGQALDMIRACNLTLKPDRNAAGRLFEDYAYGVHFSDASERAQLTRRKTLIDLADEKSAEKTRKNLQSIASPEVRQIVVEALQMRLSAGQNPKQALSKPVLYPAYGTEIWRVRCLQGYADHAVRIVHNSRQGEHEKCLLNDGYACLEIRAGENGKHQARLVTQREAQGRDFMETQQQAKRLFKGDTVIDRRDDRKYRVGYFTAEGNIFLIPFEDTRNFDKINERNSGKKKVSFNQAHRLERV

SEQ ID NO: 848 - protein, 1081 aa, Unknown
  Locus 9
MKYVLGLDIGIASCGWAVINQEKHRIEDLGVRIFDKAEHPKDGKSLAAPRRESRSTRKTLRRKKHRMQRIKVLLVKYGLLSTTEIENLYESASEIDVWNLRLDALERKLNQKEFARVLIHLAKRRGFKSNMKETILSENGQILESISENQKIMEQQNYRTVGEMIVKDNKFENHKRNKDGTYIGTVTRQQLQDEIHMIFNAQRLFINDLATEEFESSYLEIWASQRPYASKDQIEKMIGYCTLEPKEKRVPKASWSFQYFVALQTINNLRLISKDRIEELSFEEKKQIMNLALEKPIVKYIDIRKLLSISNELHFNNLLYSADTVDTTVENKKCIELKEYHSINKVYKQIYGKNALNLLPIDYDTIAYGLTIFKDDKDILEYLQNKYINTKGKTISNLTKKTYDDTFIQALLTLNFTKMGHLSFKALKNIIPFLEEGMSYDKACDKAGYNFKGTSFTKKTKYLPVIPQNTNPVVHRALSQTRKVINAIINKYGSPVSIHIETARELSKTFQERKEIDSMYQDNSKKNEHAINKLKELGNINPSGINIVKFKLWKEQDGRCMYSGEYIEPHRLFEEGYTEVDHILPYSRSLDDSYNNKTLALGIENQRKGNKTPYEYMGNTSIWYKFETRVQSNKKINKKKQQKLLLQYFSHAREQEFIERNLNDTRYATIYISAFIQQHLIFSESFSKKRVHTVSGIITSHVRSRWGFNKDRKESHIHHALDAVIVAVTSDQMIQRVTNYYKLKELNRKLQAKGILFPEPWEGFRLELEARISPNTQQYLKGICSKNYADINLSEIKPIFVSRMPKRSITGELHQETIRKFIGYNEKGKVLTAIKTKLEDIPFDANGDFPMYGKETDLYTYNAIKERYLSHKKDKRKSFQESLYKPTKTGEIGPLIKSIKIIDTRTIVNPVNQGKGVVYNSKIARTDVFKKDDKYYLIPIYTIDLMKNVLPQKAITAGKGYEDWITIDHSFTFLFSLFPNDLIKIVPSKNKEIKARSTSSKKEILLPSLTGYFKKVHSGTAGITVESHDGRFIADIGSKQLLLFEKHQVDVLGHYTKIKEEKRIGMSTCNDNKKSSAFGSL

SEQ ID NO: 849 - protein, 1072 aa, Actinobacillus minor
MVKIATSVIFAKKDIQMKALNYILGLDLGIASVGWAVVEIDQNELPIRLIDLGVRTFERAEVPKTGDSLALARRLARSSRRLVRRRAVRLLKAKRLLKQEGILQADDFHSSHLKPLPNNPWELRVKGLNHLLDRKEWAAVLLHLLKHRGYLSQRKNESKTDNKELGALLKGVSENRQLLQAQAFSTPAEIAIKKFQQEEGHIRNQRGAYSHTFDRNDLLAELRLLFQKQREFNNPYTSQSLEQAIAELLMWQKPALSGEAILKMLGKCTFEPSEYKAPKNSYSAEYFVWLTKLNNLRILENGADRGLTAEERQLLINQPFEKAKFTYAQARKLLELSDLAIFKGVRYGKDNAESATLMEMKAWHAIRKALESNGLKTEWNGLKTKPELLDKIGTAFSIYKTDEDISQYLNGELSPAVLNALLENLSFDKFIRLSLQSLAKILPLMEQGLRYDEACKQVYGDHYGKKEQLELRFLPKIPVEDIRNPVVLRTLSQARKVINGVVRLYGSPARIHIETGREVGKSFSERRDISKRQEENRNERQRAVEKFKEFFPHFVGEPKAKDILKMRLYEQQHGKCLYSGKELDLNRLLEKGYVEIDHALPFSRTWDDSFNNKVLVLASENQNKGNQTPYEWLNGKENAERWKLFQALVNGSRFPYSKKQRILTKYLDEDGFRERNLNDTRYVARFLCNFIEDNMQLVGQGKKRVFASNGQITALLRRSWGIQKVREDNDRHHAVDAVVVACSTRALQKKITDYVRYKEMNVFTGEKIDQETGEIIKFHFPEPWKFFRQEVEIRVFSETPAEDVVIALPDRPQANHEFIQPLFVSRAPTRKMTGQGHMETIKSAKRLAEGLSVSRVPLTQLKLKDLENMVNREREKALYEALKVRLEKFNNDPAKAFADPFYKKGGQQVKAVRVEQVQKSGVLVRQENGVADNASMVRVDVFIKGGKYFLVPIYTWQVAKGILPNRAATQGKEEEYWDIMDETAIFQFSLYQNDLIKLVTKKKTIFGYFNGLNRATSNINIKEHDLDKSKGKDGIYLEVGVKLALSLEKYQVDELGKNIQPCRSMKKRPPVR

SEQ ID NO: 850 - protein, 1082 aa, Methylosinus
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 851 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 852 - protein, 1148 aa, Verminephrobacter aporrectodeae
MWSARTTWRCSKSRSNCRTRCVEVLWCRGGIWSCPVERRQGLWGIAETGGRLGSKKTKTPPAGSSIWCIFLRVSVQSAYPSEVIGCEYSTIRRYDSIYQGVQMDEASVYRLALDLGSSSLGWAVLRLDRSGAPTAIIKAGSRIFSDGRNPKDGSSLAVTRRAARIMRRRRDRLLKRKARMHDQLMRHGFFPADAAGRKVLERLNPYQLRAKGLHQALTPGEFARALFHINQRRGFQSNRKTDRKDNESGALKQAISELRAQIHDSGCATVGEWFWKERMQQKPEGVHRQGVRARYRETPYTTDEGRQRIDKRYDLYVDRAMIEQEFDALWAVQAALQPGLFTDAACKELRYTLLFQRKLRPVKPGRCTLLPEEERAPLALPSTQRFRILQEVNHLRLLDEALREVPLTLAQRDALVAALESQGKLGFAPMRKLLKLPGTVKFNLEDEKRTELKGNATSAILARKDLFGPAWAGFDAALQDEIVWQLVSEEGEGRLIAWLQQHTGVDEARAEAIADTSLPEGYGSLSRKALERIVPALQREVCSYDKAVQAAGFAHHSDLGFDFEHSGDEVQQVGERIIASTGEVRPLFAFKQLPYYGKALQRHVAFGSGKPEDPEEKRHGKIANPTVHIGLNQVRTVVNALIRRYGRPSEVVVELARDLKQSREQQQETQRKQAENQRRNTRIRERIAETLGISPERVRSSDIQKWILWEELSFDVVDRRCPYSGEQISTTMLLSPKVEIEHILPFSQTLDDSLNNRTVALREANRIKRNRTPWDARADFEARGWSYEGILHRAERMPLRKRYRFAPDGYQRWLGEDKDFLARALNDTRYLSRVAANYLRLVCPKPQGVRVIPGRMTAMLRAKFGLNDVLGLDGEKNRNDHRHHAVDACVIGVTDQGLMQRFARASAQAREDGLTRLVQDMPLPWPSYRDHVERAVRHIWVSHKPDHGFEGAMMEETAYGIRKDGSIKPRRKADGSAGREVVNLIRITESRQPVRHGVDSQGQPLPYKGYVGGSNYCIEITANDQGKWEGAVISTFEAYRIVRASGWGRLRHCSHGQNGRPLMMRLMIGDAVRLALDGSEKTMRVVKISANGQVFLVAPNEANVDARNRDKADPFAYVSKKAGSFQSAKARQVSISPIGELRDPGFKG

SEQ ID NO: 853 - protein, 1552 aa, Thermophagus xiamenensis
MFSQRNNPYCELLQNVKQLYKEKFGKTNQVDNSIIYGFMKRILGLDLGTNSIGWALVENDENDRKGKIIGMGSRIIPMDMSELDNFNKGASISKTAERTRLRMTRRLRERHLLRRARLHRILNIMGFLPEHYRNSIDFIDKKGCFFEGQEPKIAYKPDKNSEQFCFLFTSSFHEMLEDFRKFQPELIQNRKKVPYDWTIYYLRKKALTQKISKEELAWIILNFNTKRGYYHLRGEDEDNQDNKKIKEFRALKVVNVTEREGANSSGKKWYDMELENGWVYSRQSNLPPNLEGKTIELIVSYTLDNNGNIKKDKNGKEKYSLSMPGEEDWNLVKIKTENDLKTSKKSVGEYIYDHLLKNPDQKIRGKLISTIERKFYKEELSRILKTQMNFYEELKNRELYQKCVEELYPNNKSHQQTLLQKDFIHLIVEDIIFYQRPLKSKRAFVNNCPLEYRVYVDKKSGELIKSGVKCIPKSHPLFQEFRLWQYVRNLRIYERERMVNGRLMVNVDVTNELLPDEEHIVRLFDLLNDRKSFKQDDVLRFVGIKSPKDRKRYSWNYPEDKELPGNETRHLILAWLKKVDGVPEDWLDPEKLKALWHLLYSVTDREEIIKGLHSFAKKYELPDTFVEHFKKIPRLEREYGSFSEKAIKKLLPLMRMGKYWKAEEIPADLLEKAQKIIDAEADDRISDEVREKLLHLKDISQLKGLPLWQASYLVYGRHSETGEVVKWRTSEDLEKYILQFKQHSLRNPVVEQVILEALRVVKDIWEHYGEGKEGFFNEIHVEIGRELKNPADKRKKITSQIQENENTNLRIKALLEELFNDPSVKNVRPYSPAQQEILRIYEDGVLNGQKEIPDDILKISKMARPSKSQLVKYKLWLEQKYRSPYTGEIIPLSQLFTSAYEIEHIIPQARYFDDSFSNKVICEAEVNREKGHQLAFEFITKRGGDEIELNFGKKVTILNVEEYQKFVKDHYGRSLRSLSKMRKLLMEDIPDDFIDRQLNDSRYISKVVRNLLSNIVRAEDENSLVSKHLITCTGGVTTRLKHEWGLNDVWNELITPRFVRLNKMGKEKFGEWINKKGKQVFQIQMPLELQKGFNKKRIDHRHHALDALVVACASRSHVNYLNNDSARANASETRYDLRNKLCYKDKTDSNGNYRWKFYKPWESFTEEAKNRLAGTVVSFKSNRRIMTRSSNRYFKWVDTSEGKKKKLVRQIKGDNQAIRKPLHKDTVLGKVSLRKEKKVSLSKAIDLWESIVDKPLKKRIQSLREQGYDKKLLLKYFKDRNNQFNGQDISRVNIYFFDNNLAARRVTLDASFNSEKRIDGITDSGIKKILYAHLQNEKYHGKKDEKGNEISPYELAFSPEGLEEMNANIKKLNGGKPHCPIYKVRLAETIGEKFKLGEKGNKNKKYVEAAKGTNLFFAVYVDEKGVRSFETIPFSVALERRKQKLAVVPEENENKEKLLFYLSPNDLVYVPDEDEKLIDYRQLSINPTRIYKMVSSSGTQCFFIPHFVASPIVQTMELGPNNKSERAWDGQMIKNVCYKLSVDRLGNVKIEK

SEQ ID NO: 854 - protein, 1526 aa, Bacteroides faecis
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWCKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYSPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNSEFEIENVRPYSLSQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 855 - protein, 1446 aa, Streptococcus sobrinus
MENQRGKRQRISHKEPYSIGLDIGTASVGSAVINNDLTVPRKRFKVRDINGNVIKTIKKNMSSVLIFDEANPAKGARTKRTSRRRYTRRNFRLLELKKLFEKEIEKIDPNFFHRIKEDSFFNWNDKEFDKHPLFGNLKEEKKFHNNYPTVFHLRNEIGKNSSKKFDLRLVYLALAHIIKYRGHFLDETFDPDASVSVEKRLNDFIVEYNELFDKDLSIEAKFSEILMSDSSNSVKIESILSLYPSEKNTIFQVFLKLIVGNQGDFNKFFKDELESSSHSGKLVFSSDEVEDEKEELISTIGEDYLDIINLCQSLYSTVALAKIINTDTGESNTPLSASMVKRYNEHKGDLANLKGIVKRFIPEKYEEVFGEQSKTGYTAYIRNPNKMPEKKFYDYLYHEGEKGKISGLLSDSRIYELPAVQKFILKIEQKSFLKKQRTKENGLIPYQLHLKELKIIIENQSEYYPFLHEIEEKLEKLLTFRIPYFVGPLAQTKYINPRFNWLVRKSEDHIKPWNFSEIVDEEKSATKFIEKLISNDQFLFGEKVLPKRSIIYQQFLIFNELTKVSYQIKDGPSRNFDSETKEKIFNSLFKKNKLGRVTVVDLKNYIKNDQCLSEKEDIQIEGIKKKFNSSYSTYADLSEISGLKELLDYDTRLDLVEEIIRILTVFEDKKMRTKQLSKLNLPSNVDIEKLCKKHYKGWANVSKKLIDGIIDGPRKSGKTILGYLKDDDILTKNKNNLNRNFAQLITDKSLDFARKLDESYKIDVKKDYPSLVEDIPGSPAIRRAILQSLYTVDEIIGVMGGMPENIVIEMARTNEVSDSPKTRKERIKKLIKETENDADALNFGISKVSEIFDEVKKDENLFKELEVYLYFLQKGKDMYVTETREAHRQPKEINFYDVKNSTGKYQIDHIIPQSLYSGNPLDNIVLTESTNNKIKDKDVPDKATVDEMKNFWLYLMKKGAISKKKFSFLTKIEQGGLSNEDKFGFINRQLVETRQITKHVARLLNALYEKDDVRIVTLKANMVTKFRKRNGLYKFRELNDLHHAHDAYLVAVIATKLLNVYPKIENELVYGKYRKESFIEKLSSDKAKQRVQFYDAIMKFFDKEEKRSQDNKEILWRKQSDLKVIRDFLDKGQVNVVRKTEKSTQGIDKKAKRNYGLFKETITKNNKHAKESGEKFVASIPIKEKLHGKKLDVEKYGGYQGLVTSFTILIFETGKKGKSKIENIPIFDRNKFEENPKAYLKEKYPNFEDYVELPKYSLLEFKKGYRRYLVSASELHPACQFRLPKRYWKFMYKMDKMIEKGVSDDSNIREELGEVNVEKMYEGLLEYCISFMKRNCLDKTFKDKKISYSETLQKNYYDKAFSDARFSSICAVHIEFRKLLSALTTKGGSTTDFFSEKGDKPLGFRYQGTGELKPDSKTGEANATLIRQSITGLYETRIDLGKLGED

SEQ ID NO: 856 - protein, 1064 aa, Ureibacillus thermosphaericus
MSKVLGLDIGVSSVGWGIIDTEKMEIIDAGVRLFEEATRNANEERRGFRGARRLKRRRNHRLERAKKLFEEFGIPTNCIGTGNPYEIRCKALKEKVSLEELAIGLYHIVKRRGTVLDAPLEEEKTGGELSTKEQLKRNSKELETKYVCEIQFERLKKGLVRSHENRFRTEDYIKEARAILNRQAQFHQEINDEFIEKYIELVQKRRAYYDGPGSKKSPTIYGRYFIKNGKFHEMSMIEKMRGKCTYFSDQPRIAKMSFTAELYDLLNGDLNKLQVNGEYLTEEDKKYIVEEIVKKGQKVTIDRILKYKGLPKDTDVRGYRVDLKNEKPIFTEFKGYKNILKLVKEHDLPKEILDNVELLDEISEILTAEKSYERRENDLKKALTNLAGFDEDTNEKIIAALKENTDFKGYHALSKKAIQLILPDLWKTNKNQMELFSELGLESKRYQNISNGKKIKFDDTAILSTVAKRAQREAIKIVNKVREVYGEMDSIVIETARENNSEEAKRKNDENQRKQKKFEKRVAEILSVSTLEELNLKPKQRLALKLWDAQDGQCLYSGERINPYDIVQDFYKFEIDHIIPISISFDDSQENKVLCYREENQEKGQRTPFHYLTSSPKAKRTFEEFRADVMKLYNSGKISNKKREYLLEQRDIMNNEELQKQFINRNLVDTRYAVRSFSMNLRSYFKHHNIPTTVLSIRGGFTNAIRRRARMNKDRNSSYAHHAIDALIVAAIGKLPVFKFFQNFGVNETGVFYDRRTGEVLTEKEFFSEDIYKFIRSLMNYESKIKYSHKVDRKGNRKVSNQTIYSTRVVNGEEYVVGKSDNIYTLNKKDAAKLIEKMRTKRDSFFIAKYNPELFDLLLKIAKEYEYADNPFKEYYEQHGYIMKDGKIPVKFLRYYEEKLGVYIDISKYYPGTQHRVILRSIKSVRIDVYKNREGKYKYLGVPYYWFKDKGNKLILDMEKYEEEKKKPYKNIDGSYEFQFSLYRNDLFSIEKKEKTFEYILLGDANSRQNILEADHVYKAKQKGDKRIFIKIGPTLQKLTKYNVDVLGNRYKIEKEDFKTTLQK

SEQ ID NO: 857 - protein, 1511 aa, Flavobacterium sp. ACAM 123
MAKILGLDLGTNSIGWAIVDKDGNDFSLVCKGVRIFSEGVKSEKGIESSRAAERTGYRSARKIKFRRKLRKYESLKVLSLNGMCPLSIEEVEDWKKSGFKEYPLNPEFLKWLRTSDDENINPYSCRDRASKQKVSLFELGRALYHITQRRGFLSNRLDQSAEGVFEEHCPQIQSVIEDVNTTDEILIELKDYFLNTGILDESIKGGFKKDLDEGEKKLKTLYNSLVAITKKNESEIEKCKEELFARLNKKEDLGKVKGKISEISQAMKDGSFETLGQYFNSLYSKGKIRNQYTAREEHYLAEFEIICKTQTIESIIDNEQLPEKRYRGLAKELYRAIFFQRPLKSQKGLIGKCSFEKSKSRCAISHPHFEEYRMWTYLNTIKIGTQSEKILRFLTQEEKLSLIPKFLRKKDNFNFEDLAKDLIEKGASFGFYKSSKRDSFHYWFNYKPTDTVSGSPVSTSFKNVIGEDWRIKTFTYPTLNSKGIEVNRTVDYKDLWHLLSVSTSDVYLYEYAKDKLKLEDKNAKSFSKIRLKKDFGSLSLNAINKILPYVKEGLLYSHAVFMANIEGIVDQAIWNDLAQRKYIQDKIAEIISNNTFDNGLLEVVNGLIKECKVEGAYYSKEAEPTYRKDLSKKLVSFFKYHEINDVLKQEKILKEVFPVFIEQLKAYEFITVKRLDEKVLEFLKGENEDGEVFCGNPKQLNKLYHPSDIDVFKKQKVRDENGKETGQLILGSPLTSSIKNPMAMRALHQLRKVLNALIVEGQVDERTRIHIEMARELNDANKRKGIQDYQNENKKEREKYKEEIKKLYLAECGKEIEPTVDDLLRYQLWIEQDRKEIYENGNSISICDIIGDNPKYDIEHTVPRSISQDNSQMNKTLCSQKFNRDIKKQKMPIELVNHLEILPRIAHWKKEAENYTREIEIIIRSTKTAATKEAKDKKIRRRHYLTLKRDYLQGKYNRFVWTEPKVGFKNSQIPDTGIITRYAQAYLKSYFKRVESVKGGMVAEFRKIWGIQESYQKDGKKYFIEKDRSKHTHHTIDAITIACMTKDKYDVLAHAWTLEDKEQVTDARKLLADSKPWKTFKEDLKKIEEEILVSHYTPDNVKKQSKKIVRIRGKKQFRDELLLDLSGNKIPIFGKRMNNDEIKSKVIGKDYFEIVSNNEKSFYEFLKDKNGDIVYKKTPLFQQGDTIRGSLHSAGNYGAIKMPQRNEKNEPIKNEKGAFILEKDKKDKDVIHFVERKALTKLSENDINNIVDPIVAQKIQKAVRDGFITFKMVQGKKVAVIKDDVIIWMNEEKKIPILKVRVFATTVKNPLEIKKHSSLSESRHKHKQMIYAQNDENYCMAIYELEGKRDFELINYFNLAKLQKQRQGYYLVNKEKEVNGKIVHIPIAKRNGRDLVLKRGKQVIFYDKEVENPDNIFDLEDLKSRIYIIEGLSIQRIVRPSGKIDEYGVIMFRYFKEARKADDIKKDNFKPDGGFKLGEIKPTRKMNHNQFNAFVEGIDFKVLSTGKFEKI

SEQ ID NO: 858 - protein, 1356 aa, Planococcus antarcticus
MLQSSNTLSVHFLLKNVKGEYFEMKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 859 - protein, 1471 aa, Scardovia wiggsiae
MGYKAPRNDKGEIDYGVGLDLGNGSVGWVAMDKDYHLIRARGHELIGARLFDPANSAENRRESRTTRRRLSRRRWRLRMLDSLFASELAKIDPNFLARRKYSWVHPKDEQNHENWYGSIIFGSKEQDKQFYKDYPTIYHLRKKLTEDTERHDIREIYVAIHHIVKYRGHFLREGEINSENLFDPEGFVELIKDVIKLNNSYDESTPIFEASPADVSEALLNEHTSRSGRIEDTLDKLDFSVSRVDKHELKGMRDAAKAVIGAIVGNTADFSKIFNLDNLDKDSKDNLKLKFADSNFDEKYGGVVGSGLLDETQIELVDRIHAVYDAVALKGILGDAHTISEAKVESYEKHRKNWKLIKEELRTKENKDEVDLWYGDLSGRQYKNPPDPEKGPDEGSKKDSPIRDSDQKQNLIKKANDYFTELIDDSQLSEEQKNCLKNDINNGQLFPVQRSSDNGVIPYQIHLNELRRIIENQKQYYPFLAETFIRKTAEGKSYEENKIVALLKFRVPYYVGPLVSKEDMEEHSSGNSAYHWMARNPGRGEAITPWNFDEVVDKDESGARFISRLTGTDTYLLGEPTLPQHSLLYEEYMVLSELNNVRLNVRQGNHWSDKNRQRLSYKQKEFLIENLFKEHKTVTRKRAEDCLSSMGCGEVQLFGLSDEKKFASSLSSYITLKKILGKAFVDDSGNSAILERIIEVQTVFEDREPLTHQLSLIDSLTVEQRKQLAKIHYTGWGKLSRKLLTSKKGSYKIHSQNEIMRTQHSIIDIMRGDSLNLIEIIRDKKIGIGEWIDNENLDRETGESDVSRLESVFEGIVMSPRVKRGVVQAVRVIDDLAKAIGNPPQRIFIEMADEVQASQRTVSRLSRLKALYGSPSLQKEFNDLKDLRKSLNETKDADLQEDRLYLYYIQLGKDLYTGKEISIDSLSSAYDIDHIVPQALTQDDSIDNRVLVSRKENARKTDSYLYTPDLIKNMRPLWGKLLAAGLMSQKKYDALTRVDDFKDREKQRFVQRSLVETRQIMKNVSTILRTYYGEDTNVVTLKSSITHDMRKYLGFPYKNRDINDYHHAQDALCISAAGQFMLNRHFVSGGEVTDGASNAYNMYLAEYLQEFRDAKARGERKRSTAFGFVVGSMSSKDDEKRTDHRTGEIVWSETNAEYLRKVMNYKKMLITQKVGDVKTRALYDETRYGHKESSAKSIKFDNLRRDTSLYGGFSGASTAYMMLVEYKKKNKLVSITAQEASLLAVADQKNDTVSVMDGILASHGLSGAKILLPKIVTGQLLDYSDALVTLQSASELNTARQMWLPRNDYNDIDIILKSKDIEDAAHKLGYDSDTVHVLRRIQKLFEAVFRVAESQFPLHQLSKDQQEEILRDPQNYGFGSAVKLLGGLLKALHANAENTNLAGLVKVLHGDKEYSDDGKAKEFKKFGFSPRWRRISNPTGFTLSDSDTFIYQSPSGIFEQRVTVKELKEKADKQK

SEQ ID NO: 860 - protein, 1128 aa, Streptococcus mutans
MANGKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVDDLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKKAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPKIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 861 - protein, 1355 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 862 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRICKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 863 - protein, 1483 aa, Tannerella forsythia
MKTILGLDLGTNSIGWAKISIDDNGNYLRDIQMGSRIIPMSQDVLGNFDSGVTESQTAVRTGFRGLRRIRERSLLRRERLHRVLHVMGFLPPHYDSAIGWNKEEPTTYGKFLNHGEPKLAWERQGDGSMRFLFMDSFHKMMEDFAPHQPALVADGRKIPLDWTLYYLRKKALTQPIKKEELAWILLNFNQKRGYYQLRGEEEEENPTKREEYHELKVVSVEAAEEGKGGNTWYNVKLENGWIYRRSSKIPLDDWVGKTRPFIVTTEYEADGITLKKNKEGEVKRSFRAPGEDDWGLRKKRTESQLEASGKTVGAFIYDHLLAEPADKIRGNFIRTIERKYYKQELADILREQSKYHEELQSKKILADCAEELYRSNQPHRDSLLKKDMVYLLLTDIIFYQRPLKSKKSLIADCPYEYYEYVDKETGEIKRQGIKCVAKSNPYYQEFRLWQFVLNLRLYDRTEDKEVTAEYLPSKEDYARLFVYLNDRKEINQETLLKDFFKLKKVKQRSEKEFPVRWNYIEDKEKKYPCNETRHELLMALDRAGIERSWLDDTARQCRLWHLLYSIEVKDEAERALRKLKDDDEFVSAFLKVKPFKKDYGAYSEKAVKKLLAVMRMGSHWCEDDICKETKERIEHILQGDVEEKIKERMNHTAYSLGELSDFQALPEWLACYVVYGRHSEATDIKHWKTPESLMAYINGFKQHSLRNPIVEQCILETLRTVHDIWKEAGHIDEIHVELGRSMKSTSDQRARMTENILRNENTNLRIKSLLMELKNDADIKDVRPYSPMQQEILRIYEEGALQELTKEDNDYEEIFKISKMPQPSAKELLKYKLWLEQKYRSPYTGKPISLSKLFTSAYQIEHIIPQSRYFDDSFNNKVICESEVNALKGNMLGYEFIKNHGGEIVHCTLLGDVKVQNESEYKAFVTEHYANNKYKKEKLLMEDIPQDFLNRHLNDSRYISKVVKTLLSNIVRTEDEMETTSKFVVSCTGGITDRLKKDWGLNDVWNSIVYSRFERLNELTKSDAFGRWENKEGKRVFQTSVPLELQRGFNKKRIDHRHHAMDALVIACASRNIINYLNNESANSPKKREDLRQQLCDKNRIIRKPWESFTQDARAALEDVVVSFKNYVRVINKATNYYERYDADGKKTITKQKSREMWAVRKPMHKETVFGHVNLRRKAIVKLKDALENIPSICNKELRDYINGLVERNFNTKQLHAHFRSTDYRWNKQNVDKVEVWRFSDEKEPLVATRKPLDTSFDAKRIDTITDTGIQKILLNYLEAKGGDPLIAFTPEGIAEMNQNIALYNDGKMHQPILKVRISEPKGAKYQIGQTGNKADKFVEAQKGTNLYFAIYEDEDRNRTYNTIPLNEVAERLKQGLPPVPEKNEKEVPLKFYLSPNDLVYVPTEEEILMKECKLNKNRIYKMVSSTGNQCFFIPFRVAVSIVNKMEYSPLNKMEKAISSEMIKAVCWKLEVDRLGNIIRVVK

SEQ ID NO: 864 - protein, 1407 aa, Chryseobacterium sp. StRB126
MIRNILGLDLGVSSIGWAYVQEDSKNSENNRIIKLGVRVNPLTVDEQLNFEKGKPITTNAGRTLARSARRNLQRFKLRRSNLMDVLKKNNILKETDLLAEVGKNSTFQTQELRAKSAKEKIELSEFARVLLLINKKRGYKSSRKAKNDEDGQIVDGMAVAKKLFEENLTPGEYSYQLLQQGKKQLPDFYRSDLQAEFDKIWDFQKQFNPEIFTNELYEKLQGKNRNATWKELEFPFSLVGIKQTGTMQEKKVEKYFWRSEAVKKQLDFESLAVVFQEINSNLNNSSGYLGAISDRSKELYFYNQTVGEYLFQQLKTNPHTKLKNQVFYRQDYLDEFEKIWETQSKYHKELTKELKEEIRDITIFYQRKLKSQKGLISICEFENREIEITENGKTKKKTVGLKVAPKSSPLFQEFKIWQVLNNLQFQNIETKEVFPIDLDFKQSIFDEVNIKGKLSAKDVLDLVGYSGKEWKTNFKEIEGNYTNENLYTAFLKIIASKEIEFPKEFKITIDDEIKVSKINASAEIIKLFVREKFSELGIDTSILDFNPELEGSDFEKQASYQLWHLLYSYEGDDSSSGNEKLYELLENKFGFKKENSKILAEIGFSQDYGSLSSKAMRKIYPYIKEHKYSVACSYAGYNHSKNSLTKEQLENRILKERLDILPKNSLRNPVVEKILNQMINLVNCLIDEYSEKDKDGQIVKYFKFDEIRIELARELKLNAEERATMTSEINKATIQHQKYAEVLQREFGLKAPSRNDIIRYKLYLELANNGFKDLYTDAKIERENLFTDKYDIDHIIPQSRFFDDSFSNKVLVPRNANLKKGNFTAFDYLEIEGKEKLEKFLNIIKDLYDKGAITKAKYEKLQKKDFEIGDGFIERDLRNTQYIAKKSKEILFGITNSVVTTSGRITDKLREDWNLINTMKELNLEKYRKLGLTETVINSKGEEKQRIIDWTKRNDHRHHAMDALTVAFTTHNHIQYLNYLNARKDEKHKEHQNIFAIENLITEIIDKKNGSKERRFKEPVKNLRAEARKHLDEILISHKVKNKVVTKNINKIKKKGSVIAKTELTPRGQLHKETIYGSSKFLKTKEEKISGKFDVETIQKVQNERYRNALLKRLQEFGGDSKKAFTGKNVISKNPIFLNNEKTEQLPETVTLAWYEMGYTIRKAVNPDNFKDFKNIEKTIDKGIRDILTKRLKEFNGNSKEAFSDLDKNPIWLNKSKGISIKAVTITGINNAEALHYKKDHLGKDFLDENGKRIAVDFVSTGNNHHVAIYEDENGNLQEKVVSFYEAVERVNQNLPIIDKEYNSESGWKFLFTMKQNEMFLFPSEDFNPKEMDLFDEKNVNLISKNLFRVQKFTIKDYFFRHHLETNVEDSSPLKGITWKREGLNGIENILKVRLNHLGKIVQIGEY

SEQ ID NO: 865 - protein, 1125 aa, Streptococcus suis
MSNGKILGLDIGIASVGVGIIEAQTGEVVHASSRIFPSANAANNAERRDFRKSRRLVRRKKHRIKRLEDLFATYQVELKGELSSENPYILRVKGLSQKLTVDELYIALKNIMKRRGISYLDDAEADGEAGQTDYAKAIERNRKLLDNKTPGEIQLDRLEKYGQLRGNFTIIDDEGQPQQIINVFSTSDYAKEVKQILECQKAYHTFISDDFCDNMLHLLTGKRKYYIGPGNEKSRTDYGVYRTDGTTLENLFGILIGKCTFYEDQYRSSKASYTAQEFNFLNDLNNLTVPTETKKLSQDQKECLVEYAKHTTTLGAKKVLQQVAKIVGCEVDDIKGYRLDNKDKPDMHTFEVFRAMKGLVPLVDIEDLSREQLDVLADILTLNTDFEGIQEALDRQLPDLFNHEQVKELASFRKAKSQLFARGWHSLSQKMMLELIPELYATSEEQMTILTRLGKFQKNDEEKGNTNTIEVDEVVEEIYNPVVAKSIRQTIKIINAATKKWGEFDQIVIEMPRDRNEDEEKKRIADGQKANAKEKVDSIKRAAELYCNGKELPDHLYHGHKQLATKIRLWYQQGERCIYTGQPISIHDLIHNQNQYEIDHILPLSLTFDDSLSNKVLVLATANQEKGQRTPYRYLQSTTAAWSYREFKDYVNKCRGLGKKKCEYLIFEEDIDVFEVKSKFIQRNLVDTRYASRVILNALQDYYKTSGKSTKVSVVRGQFTSQLRRKWGIEKTRETYHHHAIDALIIAASSQLKLWKKQENPLLIDYQKGQQIDLETGEILELTDEQYKELVYQPPYQGFVRTISSPAFEDEILFSYQIDSKVNRKLSDATIYATRKAQLGKDKVEETYVLGKIKDIYTQAGYEAFSRRYHKDKTSFLMYQKDPDTWEKVIEIILRDYREFDDKGKEVGNPFERYYKENGYIKKYSRKGTGPAIKSLKYYDNKLGNHINITPENSRNAVVLQSLYPWRGDVYFNPESGKYELLGLKYSDLRYQKRTGDYGITQEQYNIIKVQEGISEESKFKFTLYKNDLLLVCDSSTKEKQLFRFLSRTLPNQKHYVELKPYDKAKFDAGQELLSTLGVADKIGRCIKGLGKKNISIYKVRTDVLGFKYFIKQEGDQPQLNFKNK

SEQ ID NO: 866 - protein, 1050 aa, Unknown
  NCBI_AQRO01000059:170931886_7
MSKGKIFAFDIGTGSLGIAVRDGDEIIEARSLLIPPDFASTKEQRERRRQWRTRIAHKKREEWLQQICKKAGIEVLEGRKPGYKKKGISSQKGDPRLEREFASPGDDTVYTSCLLRIKLLRGEKLEGWQIYKALHSAIQRRGFDPSIPWKRKAIKKGITNKEDVKNNDMSDDNKDEKENLKKAREYEKTLMEITHGKEDWNYPCYFDAYCMKLWNPETDELRFIQTHEAERARSNEFSPSRRLVEKELRDLINAAAKQCPSLVGKTDYIMYGPTETSYASYYPKLRKQYGIKEGGENDWQGAISQKIPRFDNRMPDKCALIPRYNVCRARDHLTMKFTFLMKLKNMRYKDSFHQEHMLTAEDIRVIFDEKTEKVAKKKKELITKGTGKNIDYEKMSKIYQYTSNQWTNWLKKYKNGYSCVNHEKVDPPKISGRARYCRPAMRIMCDLILSGKSPWEFYNQLLEKMDNENPKKGLVNEDIEFLLKLPDNWEGIYIPQYTLAERFMEGEINRDSAIKKVINKQRDPIIRHRMEIFKNYIDRLTNEYGIPEKVVIELVRQDFLGPKAKRAFEKWQRENRKRNEEARNRAKELGISGHEGRTKLRLFKQQNGYCLYTGENLSENELEQYEIDHIVPRGGGYNGSDSFINKVVTKAKTNHDKGDRTPYEFLSQSGKWDAYLERVKKVTSSLGKKKSALLTSEHPEELDEKYTQLAETAWIARIARDIVCLFYGWQYGEKGELEKALVVDGKLTSNVRAKYGLNTLLAGGNETDPEKRKEKNRDDKRHHALDAMVLSFITRNKPDLPEGVHKELFRKWINKVVPEQIAFEKPQLEETIYGKRTIYERNKEKEIIVKRVDLKDMAYRNGKYDKIKAQKEIQGILDVTLRKRLERFLETNPEKETWNSFIDNLRQQDRWGSRVKKVRIYEGEPDEYANLSKTDDKGQFRRGDKHRGQFVYLSEKKIPKVRPVYVFESVKSVKNELLKEGYEIIDFFKSGFLIEIGKSFDYNGRFIPSGKYLLSSLRSNGQVQLNSTHPNLKNPIGISALLKAGFIRIK

SEQ ID NO: 867 - protein, 1457 aa, Bacteroides propionicifaciens
MKKILGLDIGTNSVGWAIINKDSDGPQSIVNLGSRIIPMSQDVMDKFGKGQTVSSTAERTGYRGVRRIRERSLLRRERLHRVLHILGFLPKHYDQVIGWDRSDNRTYGKFLPGIEIKLSWVPTDSGNQFLFMDSYLEMLKELKQEQPELFETSDTPAPMDWTLYYLRKKGLKQALRPAELAWIILNFNQKRGYYQLRGEEQEVDPKKREEYHALRVVRVEVDPESGSLSKPWYNAYLENGWIYRCQSNKPLDSWVGMIKDFIVTIHLADDGSEALDREGNVRRNFRAPGEDDWTLLKKKTESDLQKSGKTVGAYIYDTLLKQPSQKVRGELVRTIERKFYRNELELILDKQLEFIPELKSKELFDACANELYPSNHNHRANLLTKDFKYLFVNDIIFYQRPLKTKKSLIANCPYERRSYKKDGERVYVPIKCIAKSNPYFQEFRLWQFIENLRIIQHQKEMDDSIQYNVDVTSDYLPDEVSYVKLFDWLNERKEVKEDQLLRNFFNLKKDKISKEFSVSWNYVKDRTYPCNETRALLISGLEKCDSLSWLDSKEKEYRLWHLLYSVEDPKELRGALAKLADKESLSSDFVDIFSKLPSFEKDYGSYSEKAIKKILPIIRKGSYWSADAIDSRTQKRIQQIIDGEVNESIDMRAREKLESLREIAAYKGLPLWLAGYVIYNRHSEAGEIKKWNTPEDLEYYLTHEFKQYSLRNPIVEQIILETLRLVKDLWEKYGDLSEIHLELGRDLKNPAKKREADTKRNVDNENEWMEIQEKMLEFHREGLISNPYSPSQKMKYKLWLEQNHISPYTGEAIPLTKLFTSSCEIEHVIPQGRYFDDSFTNKVVCESEVNKLKSSMLGHEFIKSKGGEAVLIGGTQVRILSVPKYVALVDRLYSSTNPTKASKLLLEDIDDLNKDFSERQLNDTRYISRYAMSILSAIVREDDEKESVSKNIITCSGKITDVLKRSWGLKDIWDGLIQPRFERLNTMYDTQEFGKWVTSNKFQVRIPLELQRNVSKKRIDHRHHAMDALVIACATRNHTNYINNMSAWRGEDYKKVRYDLKKKLIDENSSERDTFIKPWPNFTVDAKKALERIIVSHKKNLRVLTATVNHTEYIDNQGKRQLKKQESNDHYAVRKPLHQETIFGRVSIRSIKQVTLSKALENYKSIVDKHLKAKVREVIAEYGGKVDSKTLNKYFKDRDYKYEGLDIKRVEVYHYDHDCAATRKPLNDSLTLKQIEKVTDESIRKILYNHLDNYAGDLKEAFSVEGLVAMNKNIKTLNGGVPHHPIYKVRLFEDLGSKFALGTTNNNPSKFAVAAKGTNLYFGVYVDENGKRSFDSIPFNVVLNRIKSGLSPVPDVFGKSNLLFYLSPNDLVYIPSSIELNEEFCINEINNNRLYKMVSSTGFQCFFSQNNMAQSIWDKKEFSALNKMERDIEGNMIKQVCWKLVVNRIGEITDVIR

SEQ ID NO: 868 - protein, 1126 aa, Streptococcus henryi
MTNGLVLGLDIGIASVGVGIIEAETGKVIHASSRIFPAANADNNAERRGFRGGRRLTRRKKHRVKRVRDLFDDYNIATDFSNLNLNPYELRVKGLTEELTNEELFAALRNISKRRGISYLDDAEDDANSGKTDYAKSVLANKELLKTQTPGQIQLDRLNKYGQLRGDFDVVDENGEIHRVINVFSTSDYRKEAEKILQTQSQFNNAINQEFINDYIDILVSKRKYYHGPGNEKSRTDYGRYRTDGRTLENIFDILVGKCTFYPEEYRAAKASYTAQEFNFLNDLNNLTLPTETKKLSIEEKLYLVDYAKNTPVLGPDKLLKEIAKLVDCKKEDIKGFRIDNKEKPDMHTFEVYRTMSKLDKVDIQTLSRETFDELARILTLNTEREGIEEAILKDLPNQFTNEQIEELIKFRKDKSQIFGKGWHNFSVKLMLELIPELYDTSEEQMTILTRLGKTSANKKEVKRTKYINENDVTEEIYNPVVVKSVRQAIKIINASVKEWGEFDNIVIEMPRETNADDERKFIKKMQDANAKEKKDSEERAATLYNGKTELPSNIFHGHNQLATKIRLWYQQGERCIYTGQKIDINDLIHNHNMYEIDHVLPLSLSFDDSLANKVLVLATANQEKGQKTPFQSIPQMKSAWSYREFKSYVLGCKGLSKKKREYLLTEEDINKIEVKQKFIERNLVDTRYASRVVLNTLQDSLKAMNKKTRVSVVRGQFTSQLRRQWKIDKSRETYHHHAIDALIIAASSQLRLWKKQGDTMFEDYKNGQKVDLETGELLSDNEYKELVFQSPYQGFVNTISSKAFEDEILFSYQVDSKVNRKISDATIYATRQAKLTKDKKEETYVLGKIKDIYSQAGYDAFRKRYEKDKSAFLMYQKDPMTWEKVIEVILNDYCEFDDKGKETGNPFEKYRNENGYIRKYSRKGKGTEIKSLKYYDSKLGNHIDITPENSKNSVVLQSINPWRADLYFNPKTLKYELMGLKYSDLSFEKGTGNYSISQDKYDEIKSREGISPKSEFKFTLYKNDLILIKDTINNKTLTARFNSKNDTSKHYVELKPDSKAKYDSEEVLIPVFGKVAKSGRFIKGINKTGISIYKIKTDILGRKHFIKEEGDQPKLEFMKSSKNNK

SEQ ID NO: 869 - protein, 1049 aa, Unknown
  NCBI_ASKP01000047:127544_4
MKRYRLGIDLGATSLGWSMIELNEDNTPKDLLDLGVRIFPDGRDAKTNEPLNVQRREHRSMRRNRDRYLQRRTYLLDTLVKYVLMPQNEHERKQLEYLDPYVLRAKALDEEITLYELGRVIFHINQRRGFKSSRKMDSAEKETSRMKEAIKELKQRLDNVGARTLGEYLFNLNKDIPQKNQNKLRPLRIRDYGKEYNLYTDRKMYENEFDMIWNKQSTYHSELTEDVKEHLKQIIFFQRDLKPQPKGKCRFEIGEPRCPVAFPVYQQFRIYQEVNNLILLDYDRKEHELTKAQREMITQTLLKQKSATFKSLRKKIGKEYAGDYVFNLESEKRKDMKGDETSFILRKIENFGIKWNELSEDEQDEIITRIINEDNDIEIEKNLITWLCKSFGLKNENAENISNVRLPRGIGSVSKKAIRKILPYLKEGFLYHEACQKAGYHHSDFRTGEIYDEGNLPYYGKIMQHHAAFGSDDPNDIEEIQYGKIANPTVHIALNQLRKFINALAEKYGAPTQIVVELARELKLGQKRLREIEKEQTHNRKHNEEIAEELKKVGIENKYQNRLKYKLWEELDGDPAKRCCPYTGKQISISDLFSNKFEIEHILPKSKTFDDRPTNKTVSYYIANKFKGERSPFEAFGESPENYNWDKILERCENFPPNKRWRFYPDAMKNFEDQGELISRMLTDTQYMSRIAKEYMSYVCGPNNVWAIPGKLTSKFRAKWGLNELLSEDSKKNRADNRHHAIDAFVVACTDRAMLQKVARATESTRERFIEKMPPPFEVFCHDEMQEKVNNIVVSYKPDHGNAKAAILRNQTVGQLHEETAYGFVSEDEEKGKITLSVRKPLISLESVKNINEIASSKIRNELLTLAEGVPKNEIKAILANYSERTGIKRVKLHVEKDKKTVIPIKNKNGEIYKYYLSGNNYCADIYCPNKGEKDGKWQIEIIPMFKAHKQDFEPEWHKKYPTAKKIMRLFINDYVAYDDEGKRKIKRVKKMSVDGRLFFIDPKIAKTEKEPNATSVKQLQERNARKIGVDILGKIYDSQKKNENSRDK

SEQ ID NO: 870 - protein, 1068 aa, Unknown
  NCBI_ASNV01000012:3456765130_16
MSDSNFYSPYVLGLDLGSNSIGWALIKLDNDDNPCGIEKVGVRVFEAGMEGQYESGKEESRNKKRRDARLVRRQIERRARRYRRLANVLQQIKLLPEGNLNDSLERKNIIDNLDVELRKMYIKEDLPEYEKNRLNQIFLYYLRSLAVGQKLEPYALGRVLYHLGQRRGFLSNRRGQKKDDEEKGKVKEGIAEIRKEMACLGARTLGEYFAKIDPIAEQKRIRGRWTARDMYEQEFYTIWDQQAQFYPDILNDENKKLVFKTIFYQRPLKSQKEKIGFCQFECIARGGQRNRRRAPWVILKAQRFRLLQKVNDLEIKEDKFNKRPLTGEERKVVIDYLEKNGDTTFAQLRKILSLPKTVKFNLEEGGEKKIPGNKTASAIRNVIGERWDNMNAEERDKLVEDIYSIVNNKALERRLIKHWKFSEEEALQISEMIIEDSYCNLSRQAIDKFLPGLEEGRRYGELVKEIYGMDNVRDEFKVDLLPPLEEAPIGEIRNPTVTRTLAEMRKIVNELVKRYGKPRFIRIESAKDLRNTKKEREKIWKNNRDLEENRNKIRQELINRGIPNPTRSDIEKYMLAEECGWKCPYTGRPINGFNALFGSEPQFDIEHIIPLSRCLDDSFKNKTLCYHEENRTRKHNKTPYEVYAFDESRWEAILGRVEKFNSHCAAEKLRRFKLHGKALEDFIDKFSSSQLNDTRYASREACMYCGLLYGSEYRKHIFAVSGSATSVIRRMWDLNKILGSPEKNREDHRQHAIDAIVIAITSPSMVKRISEQAENIPIKERKNKNWWRFIEPPWATLSKEAEEKVLSIIVSHRPERKVSGRLHEETNYSPPKIDENGETVVHVRKSLSNISKGEIDDIVDPIVRKAVQDKLIELGGDPKKAFADPMNYPLMPNKKGLQIPIKSVRVKKKVPVFPVGEKERVRYVTSDENHHIEIFETKDKKGRTVWDANVVSMFEAMQRKKRGEEIIQRKLIRDGKEVEDAKFLFSLCKGDIVFMKDIKDESKYEYFKLIKMDINCVLMFLPIYMARIPEKNGKKDFTGLTRRLSSLLSSEAKKHSVNILGESQIAHD

SEQ ID NO: 871 - protein, 1028 aa, Unknown
  NCBI_ASWY01000120:2294253111_16
MSKKVFAFDLGTGSLGVTVRKGIEFKEIHSYILPPEFASLKDQRERRRQYRTRLSHKAREDWLKKNCREAGIEILEGQKPRNKKEGTEPKPGDPRLEREFAEKGDDTVYTSCLLRILLLRGEKLEEWQIYKALHSAIQRRGYDPEIPWKHRAEQKKDDDSKTEKQATEYEKKLINITGGREDRIYPCYFDAWKMGLWNPETDKLEFKQKNTADRARKNVAPRKLVEKEIRALVRAASKEYHFFKDKEDYILYGKPKEAYASFFHELRLKYGLREGSDEDQKALLGQKIPRFDNRVVNKCVLIPRNNVCRADDYAVIQFTFLMKLMNLRFYDTTNHERRLLPEDIRKILEEKKEKADKERELMKSEKEQKREIAIKTAKIFSFTITDLKKWLKKNGKNWTPQVFNKKEKPVEPPKTGGRSRFCRPAIKQMRELILSGKSPGKFYTEQLELITNNDPQKGIVWKDIEFLLKLPDSWGKIYIPQRTIAEQYSENAETPDEAIKNLISAEINPVIRHRLGVFDKTLSRLAETHGTPDRVVLEFVREDFLGKDAKSALLKSQQKNRKAREEARQRAKEINATGKDAFTKLRLLKEQKCHCIYTDEALSESDLDLLVIDHIVPRSSKYDGADALWNKVVTTYITNDEKKDRTPYEFLSNTGGWQAYCERVKKSGLSNRKKRLLSSENPEEFNEKYTNLAETAWIARLARKIVCLKFGWQYGEKDVKEKVPVVHGGLTWAIRGKYDLNSLLFDVKDKTPDVIEKKNRDDKRHHALDAMVVSFLTGHEHEKKLPDGVARPLFEKHIKDVLPEPIATEKPVLEETIYGKREFGGKTVAVKRIELVSIGMSGKTFNVRKARNDAENILDDSIRKHILQFLETVPDKDTFLEFCKTVRQSGNKGSIVRKVTVSKGDIAEYKDLGKNVGKGQYRRGAKHRGQFIYRNTQGKVKVRPVYVFESKKDIEDELRESGYETLAFVQAGCRFEINKGVTVGERLIPPGKYIFNTIKTKSGQVVIDGDFPSPRIGKLIEAGFRRLK

SEQ ID NO: 872 - protein, 1319 aa, Weissella halotolerans
MAYSVGLDIGVGSVGFAGIDNQYNLVRTKGKNVIGVRLFDEADSAAERRGHRTNRRRLQRRRWRLRLLDDIFAKPLQAVDPNFLARLKYSYVNKKDQGQQDHYYGGYVFGSTAADQAYHQAYPTIYHLRKRLMEDDQKHDLREVYLAIHHIVKYRGNFLNPQSSLDIDQQFDVTDFAQALARFADHQALSWALEAPIRFLEAELATGLSNSARVDAAIEAFSFDTKVDRAAIKEMLKGLSGNQIDFTKLFVNVDSADWDQEERKQWKMKLSEEDFDEQALPILERLSQDETEFFLAIKRAYDGIALMRFLGDEQSLSSAMIKAYEDHRRDLTFLKTQVRTPQNRQALSEGYTNYLSVDDKKHKRGAKELAQLIEASDASEQDKATMLDRIANDQFAPKQRTKANGLIPYQLHLAELKKILAKQGQYYPFLLDTFAKQGQSVNKIEELVQFRVPYYVGPMVPKSETAGNAENHWVEKNDGQTKVSVTPWNFDQVFNRDRAAKSFIDRLTGTDTYLIGEPTLPRHSLTYETFTVLNELNNIRIDGKRLPVETKQAIVEDLFKKYRLVTKKRLQDYFASFGKREVELTGLADESRFTSSLTSYHDLQGLLGTDFITNPQNHSLLEKIVEIQTVFEDSDIAERELGKLGLEQKLIPRLAKKHYTGWGNLSRKLLDTSFIHDPERPEEPVSIMDLLYTTNKNFMEILHDSEYGVEEWLKSQNMIDDQKDIQMRIDELTTSPANKRGIKQAFNVLDDITQAMGEEPAYVYLEFAREKQASRRTVSRKKRLETLYKNAALKTEFKAIKEALAEESDDRMQDDRLYLYYAQLGRDMYTGQSISIDQLSSHYDIDHIVPRAFIKDDSLENKVLVNRTDNARKTDSATFTADVKAKAFPLWQQLKKLGLISAKKFRLLTRTGDFTEMERERFIARQLVETRQIIKNVAALIEGHFSQTQAVAIRAEVTGELRQLTQIKKDRDINDYHHAQDALLVATAGTYLHRHFPKRDARFIYNEFDYYTQHWLKNQGENRRRHPYSFVVGTMSKGNEDWTPDNLNYLRKVMQYKTMLMTRKPVGPEGALYKETLIAADPKKRLVGASKERQDPTIYGGYTKESSAYMSLVRAGGKNQLVKIPVRIANEIHSGQRKLDDYVQAKVKKFERILLPKISLGQLVEDEGQRFYLATNEMKHNAKQLWLDQKVVTTYKRLTAESPVEDFLTVFDALTSSATIHHFKFYQRDLELLRDNRAGFQDLAKATQLKVLKDVLYELHDNAGWRDPIKQYFKEIGLKVRMWTKLQKEGGIKLTDQAELIYQSPSGLFEKRRRVQDLL

SEQ ID NO: 873 - protein, 1385 aa, Lachnospiraceae bacterium NK4A179
MAEKYYVGLDLGTNSIGWAVTDERYRILRKKGKDMWGARLFNEAESAAGRRTARVARRRLERQKARVGYLKKVFAPYLSEVDPGFLQRLEDSRFFEEDKTEKQKYALFSDKDYTDRDYLKKYPTIFHLRSELLESKEPHDIRLVFLAVLNIFIHRGHFLNQGLKEGTLGDIREWMKVLDENLEMLYQDRDWHMAVNIEEQQRILSSKELTATAKLEKLLSTVGIEKKDKDNKPLIEIYKLICGLKGTLAVAFDGEITDEENLKFSVSFRDSAYEENERKAEDLLGETAFETFKVLKEIHDWGVLSSIMKGDEKTYSYISLAKVDMYEKHKKDLKVLKKVIKTYKADDYNRLFRSMEDNTYSAYVGSVNYKNRKIRRGAKSDAFIPGIKKIVEEIYKSNPDSDCEYILNEISKDNFLPKLLTTANGVIPNQLYAAELRKILDNASEYLPFLNEISEDKKGLSIKEQLIALFKFQIPYYVGPLKRSESGKAWVVRKNDGTVYPWNIDDMVDMPATSEEFIKNLINDCTYIEGEKVLPRNSLLFEKYKVLNELNNLKVNEQKISVELKQDIFINLFRKNGKKVTNKSLLSFLKSRGIIEAKATDDCLSGYDKELGGFTGTLSNYEKFKQIFDTEVLTDRQIEIAEDVIYYSTVYGDSRSYLKTILSDKYGDVFDKKQLDRLIGIKFKDWATVSKEFLQLQAPEKMNGEVVTIISALWNTNMNLMQIINAPEYGFADELSEKRKKLSKTLTEITYEDIEDSYMNAPVRRMVWQTIRILQEIVGIMGSEPEKVFVEMARYEGQKGRKGRKDSRKKKLMALYKKCEDDEKNLVTEIERRDEKDFRIKKLYLYYLQRCKCMYSGRPIDPEKLLDDNYYDIDHIYPRHYVKDDSLENNLVLVESKYNRDKSDDLLGEDIRMKMKDEWKDLLDRGFINNTKYARLMRREAFTDEEFATFIERQMVETGQGTREVTRILGEALGNTGENHKVIFVKAGLVSQFRKYNADAGCPAFVKSRIINDHHHAKDAYLNIVVGNVYYTKFTMNPINYIKELRNKKNPTKNDNYHMDIEKLFDRLTERNGYVAWNPDEDRIVVRKMMEKNSPIITKRTYMNHGPISKLNPISPKEFGKAGGKSYLPLKTSDQRLINTERYGGYSDVKGAYFFLVEHTVKKKRIRTIEPVYVYMTEKMSGKEHLEEYCREQLGYTDPDVRLEKILMNSLLKVNGFNLYLTARTGNSLAVCNAEQLTLDMAKAAYTKTIAKAIEEKASEEYLRKMHGKSAAVITCENNLELYEALCDKHNKGIYSIKPTSIGAVIEKGKESFKVLDLVDQVYVLNQILIATQLLNNGVDLSLIGGSSSVGKTRINKNITGNREIKLIDQSVTGLYEREIDLLTI

SEQ ID NO: 874 - protein, 1390 aa, Gemella cuniculi
MESKKWYLGLDIGTASVGWAATDTEYKLLRKNRKRLWGVRLFEEATTAAERRGLRAGRRRLARRKWRLNLLEELFAEEVVKVDKNFFLRLRESKYHFEDKTNKETFTLFNDKKYTDKDFYKEYKTIYHLRKELMTEKNPDIRKVYLAVHHIIKNRGHFLLQGQSFKDGNIDNFIKELLNLEFVKVGFEITDEEIEKIKYISLQKKNLSAKVDDLKKLYPKEKQLHEIFKLIFGGKPTLDKLFNIAEYKELDSDIKSISFKNKIYEEERPKYEDVLSNYIELLDLAKQIYDGIILSDIKKVGQTISESKVESYEKHSEDLDKLKSLIVNDAELSDEKKKEIYYAIFKEDKDKGTNYVNYTLRSREGKGCSYEDFKKFLEKELDKLESSEIKENIIKELKLEEFLPLQRTKDNSVVPYQVHKEELVKILDNATKYYDFFNKKDENGFTVKEKIIQLLEFRIPYYVGPLNSYHQAKENGFAWSVRYDNEENTAVTPWNFERVIDADASAEKFIRNLTNKCTYLKNEDVLPKHSLLYSEYELLNDLNKLRYDGNRLTVEARDAMVENLFKKQGKKVSAKVIEDFLKVNGFTDGRGKISGIDVTIKSDLKSYRDFKNILGEKFDTERVENIINWITLYGESKKLIINKINKVYGDYYTTEEIKKISRLTYKGWGRFSRKLLTEIVSEKFFNEETGECLNIINALRQNTMLLMEILANQYGYMEQIKDYNKRLQKEIFEITPDLLDDLYVSPAVKRSIWQTIRIVEELKKIIGSTPEKIFIETTRTNQAEKKRTNSRKDYLASLYKNIKDKEILELEKSLGTSLDFDKNKSKLMSVEPSELKAKKLYLYYMQLGRCMYSGERILLSELFDNNKYDIDHIYPQSKVKDDSFTNTVLVKREINEEKGNNYPLEKSIQDENKNFWLFLKNKDLISDEKYNRLVRTKDFSDDELTGFIARQLVETSQSVKAVANILQELNQKSVICYSKAENVSEFRENFGKIKSNNLESQSKEKLIKVREINDLHHAKDAYLNIVVGNVYDVKFTRNAYNFITKEKNGRQYSLNKIFYRNVKNSKTIAWEVDKTINTVESVMNNNSILVTRRTSEQKGGLYNENISKAKKSKDDSYYPQKTSDKRLIDVAKYGGFPKIKIAYYSIFECITKNKKGEEKITRIIPIPIYISQNIKNDSALTDYAKSQIKAKYAEEIKDLKLKYRKLCIGGLCKLNNFSYYVGGKTSEYFNFDSAIQVILDNNSEKYIKEIVKYLNWKKDNKDGELWKIITSEKNIKLYNTLVKKMNSNTLKNKKLNNYNELKSGKVFFKFKNLNKEEQITVLLELLYVLTEKKTTFNLKLINLTATRAKNRFDLTNLNQFSIIEKSITGFYEKEITIIGEKNNDMENNSN

SEQ ID NO: 875 - protein, 1355 aa, Helcococcus sueciensis
MVKKDYYIGLDIGTSTIGWAVTDEEYNLMRSKGKDLWGVRFFQEAQTAADRRVHKSNRRRLMRRNSRLQILREIFEDEISKVDPEFYERMDESKYWVEDKKVSGKYSLFNDKNYTDKDYFKEYPTIFHLRKSLIKHEKKADIRLYFLAINQIMKRRGHFLIDGKLNNVTDIEPLKLQFISILNDKYIEEIDENFIDEAFDIISDINEKKTNKKNQIKQLLNRYSFSKDESKVLKNIFELIISGKGKVKNIIDDENIAEKLKDDKKEDFLLSGEAYEENLDYFESVLSEDILLFTTIKSVYDFTLLQDILRGSEFLSFAQVERYNEHKKYLEKLKLVIKRYDNTKERKLYNEIFKSIDNPKGYVAYLGHHEKNGKKTVVKKITNQEFADYIKKMLKENTDLNDNDVKDILNKIEKDEFLLKQISSKNSVIPYQIHQFELERILDNLVKDYPSFNEIEEGFTKRDKISKTFSFRIPYYVGPLNDYHKNNGGNAWIFRNNDEKIKPWNFEQVVNLHKSEDEFIRRMLNKCTYLPSETVLPKSSLLYSEYMVLNELNKLKIGDSYLSVDVKADILENLYRKDPRVSLKKIREYLIRTNKAEPNDFQKGETNQEIKSNLKSYIDFTNILKDKFDYEMVEDLIEKITIHTGNKKLLTKYIKDTYSNLTAYEIKEITSLKYKDWGRLSRKLLVGIKETNLETNRQDSIINFMRLTNDNFMQIVEGPKYTFKGYIEKERLSGLSDNLDYDVIDSLYVSPSVKKMIWQVLKLTEELVKVQGYKPKKIFIEMARSDEEKKETVSRKNRLLELYKAIKNDKESLIADYEYDKLIKGIQSTEESDFRSKVLFLYYSQLGKDMYTGENIDLNHMFDKTIYDIDHIIPRRMKKDDSITTNLVLVNKKSNQDQKKDIYPVPSTIRNNPKVYNLWKLLVDKEFITKEKYNRLIRKDELTNEELAGFISRQLVETRQSTKVVKELFEKYYSDIKIITVKAGIVSELRHDFNVLKSREANDLHHAHDAFLNIIAGDVWNKKYTSNPLNFVKENRKSKQVNYSLNHIFEKQQKVRDKIIWEPDKGKELIIKTLNKPSVLTSSEAFEQKGALYNATIIGKKDFKKNTKYLPLKKDERLSDISKYGGYSSLTGAYFYLVEHTVKGKRIKTIEFVPLHLSNEIKEDKDKLLKYSTDELGLINPEIIIKKIKYKTEIEVNGFRYLISGRTGNQIILEPNMQSFWNIEELNILKTLQNKYEKGMFSNTDKIEENDIFNMKLILNKLIQKLSSLPYINRINMPVIDKSKIDDVKVSELFIIINNLLILLNKTVMASDLSLIGLAKASGRTLLSKNIEKYNSFMIIQKSISGIYEKKIRII

SEQ ID NO: 876 - protein, 1062 aa, Thermithiobacillus tepidarius
MQAPSKAEYTLGLDIGMASVGAALLTNDRILALHVRAFDKAETAKEGESLNAIRRAARLTRRRLRRRAHRLLRLRRLFKGMGLLDSQDPAALFTGKSPWVLRSEGLDRRLTSPEWAAVLYHIVKHRGFHSSRKSEAKADEQIGQMLSGVNRIKELLANTGLRTVGELAAKHEAFAEAKRNKGGAYTHTFARADLAAELSLLFAAQRRFGNRHADATFESAVRDLLMARRPALSGERLLKMVGKCTFEPTEFRAPKASHSAERFVWLTRLNNLRVSGLGETRPLTDSERATLMELPFAQAKLTYKQARKLLGLAEHERFAGLDYRDKDPENATLFEAKAFHALRKSYEEAGLKALWQRDALDPERLNTLAHAQTVFKEDGEARAWLAGQGVEPEIIEAVLNVAFSDFVRLSVKALRRIIPHMETGLRYDEAVRAAGYVHHSQLPGSKRALTIPRISKDDFPNPVVYRALNQARKLVNAIVREYGPPVRVHIELARDLSKSFDERKRIEREQKSFRENKQKDIADFVERFGVTPKGADLVKWRLYREQNAQCAYSQKAFDLDRLFEDGYAEIDHILPYSRSFDDGMSNKVLVHTAENRNKGNQTPYEYLDGQSDSERWRRFVAWIMGNKAYRQAKRQRLLRKDFGEAAAREFRERHLTDTRYIARSFKRLVERHLQLAGDTSNTRCMILSGQLTAFLRARWGLLKVRENGDLHHALDAAVVAACSQAMVKRLSDYSRRGELEQVRKGYIDPETGEVLDLAALRRLEAQFPTPWSHFRDELLAWLSADPATRLARLPNYPAKQAQRARPVRVSRAPTRRGTGQAHQETIRSAKRLGNGVSTVKTPLQNLKLKDIEKIAGFDDPRNATLLEAIRQRLEQHGDDGKKAFKEPLYKPGKPAPVIRSVKLMETQKSGLAVRGGVANNGNMLRVDIFTDGKRFHAVPLYVADAIKAELPKRAVVAYKPEAEWTVMDDKYAFLFSLHPNDWVVVTLKGAGQPLAGYFAGLDRSTGAISLWTHDRNQTVAKDGLIRGIGIKTALAIEKFHVDMLGRLHRVRQETRQRLRRAG

SEQ ID NO: 877 - protein, 1100 aa, Butyrivibrio sp. AC2005
MGYTIGLDLGVASLGWAVVNDEYEVLESCSNIFPAAESANNVERRGFRQGRRLSRRRRTRISDFRKLWEKSGFEVPSNELNEVLQYRIKGMNDKLSEDELYHVLLNSLKHRGISYLDDADDENASGDYAASIAYNENQLKTKLPCEIQWERYKKYGAYRGNITIQEGGEPLTLRNVFTTSAYEKEIQKLLDVQSMSNEKVTKKFIDEYLKIFSRKREYYIGPGNKKSRTDYGVYTTQKNEDGTYHTEQNLFDKLIGKCSVYPDERRAAGATYTAQEFNLLNDLNNLVIDGRKLDEQEKCQIVDAVKHAKTVNMKNIIAKVIGTKANSMNMTGARIDKNEKEIFHSFEAYNKLRKALEEIDFDIETLSTDELDAIGEVLTLNTDRKSIQNGLQEKRIVVPDEVRDVLIATRKRNGSLFSKWQSFGIRIMKELIPELYAQPKNQMQLLTDMGVFKTKDERFVEYDKIPSDLITEEIYNPVVAKTVRITVRVLNALIKKYGYPDRVVIEMPRDKNSEEEKKRIADFQKNNENELGGIIKKVKSEYGIEITDADFKNHSKLGLKLRLWNEQNETCPYSGKHIKIDDLLNNPNMFEVDHIIPLSISFDDSRANKVLVYAAENQNKGNRTPMAYLSNVNREWDFHEYMSFVLSNYKGTIYGKKRDNLLFSEDIYKIDVLQGFISRNINDTRYASKVILNSLQSFFGSKECDTKVKVVRGTFTHQMRMNLKIEKNREESYVHHAVDAMLIAFSQMGYDAYHKLTEKYIDYEHGEFVDQKGYEKLIENDVAYRETTYQNKWMTIKKNIEIAAEKNKYWYQVNRKSNRGLCNQTIYGTRNLDGKTVKISKLDIRTDDGIKKFKGIVEKGKLERFLMYRNDPKTFEWLLQIYKDYSDSKNPFVQYESETGDVIKKVSKTNNGPKVCELRYEDGEVGSCIDISHKYGYKKGSKKVILDSLNPYRMDVYYNTKDNRYYFVGVKYSDIKCQGDSYVIDEDKYAAALVQEKIVPEGKGRSDLTELGYEFKLSFYKNEIIEYEKDGEIYVERFLSRTMPKVSNYIETKPLEAAKFEKRNLVGLAKTSRIRKIRVDILGNRYLNSMENFDFVVGHK

SEQ ID NO: 878 - protein, 1350 aa, Butyrivibrio hungatei
MANVKYYLGLDMGTNSVGWAVTDENYKILRAKGKDMWGMREFDEAKPADERRTNRISRRRTMRSKARIGLLNNYFEDEIAKIDPSFLQRLANSKYHLEDKDEAVRYKYAIFNDKNYTDKDYFKEYPTIFHLRSELIHNESPHDVRLIYLAVLNMFKHRGHFLANGIDTTNDVRGIEDAYYGFVSNANEICELNFPEENVDLNKFKTILADRKLSRSQKVDELSELLAIGKKEKDFVKAICGLKFDINKIFELGIEDKSVKTSFAFSDSNYDENESEILGLAGDDYSDIILSLKELYNIGTLEVIMRGSSYLSDARIKDYEQHHEDLKILKRVVKTYCPKEYHKMFRSEDSGTYAAYVNSTNSGKKTRRNYKSRTTEELYKSIKAILKSAPADDEDVIYITEHIERENFLPKQLTPSNGVIPNQVHEREMRKILDNAGKYLPFLTQKGESGNTIADEILAIFTFTIPYFVGPTSESSKKYGGNGWVIRKEEGKILPWNINDKIDMDKTNEAFIEKMVRRCTYISGEIVLPKSSLLYEKYCVLNEINNMRIDGERINSELKQDIYTELYEKGSKVTRKKLENYLVSRGIITDKMQISGIDENLNNYLSSYGKMKGVFGEHIKEDKCRDMCENIIFLATIYGDNRKYLRGRLMKEFPELSDEQIKRILGLKFSDWSRLSKEFLLLRACDKSTGEEISLIDAMWNSTHNMIELINSDDYTFRDELENLQKSSMGVLSDFKFEDLDAYYFSAPVKRMVWQAIKIVKEIEGIMGCAPAKLFVEMTRSEGEKKRTVSRKNKFLDLYKSIKDESHDWNDIITKADEDGTLRSKKMYLYLTQQGRCMYTGRHIELDKLFDNNLYDIDHIYPRHFVKDDNIENNLVLVEKEKNAHKSDVYPIEEAIFKSQIGMWKELCNKGFISKTKYSRLISRQPLTDEQKAGFIARQLVETSQATKGVNTILKELLKENTTIVYSKASNVSEFRQKYEIPKSRLVNDFHHANDAYLNIVVGNVYFTKFTQNPIRFIKNEYNKDPDKFNYHLTNMYAHNVERNGETAWVASSDDTKGTISTVKKQLSKNTPILTRMTFENHGGITRKQTIWSSKITKQDVYFPVKSSDKRMADVTKYGGMSDIATAYFFLVEHDVKKKRVRTLETVPVYLSKRIEKDSSLLEQYCMQNLKLVNPDIRVRKINIQSLIKKDGYYLNISGTTGNRITVRNAVGMCLGQKWNGYIKKIEKYVAQEIADDVLTIEKNNELYDEILSKHKNTIFANKPNPSFETIEKGKEKFLHLDLYGQINALYQVLSLTAIGFGRADLTLIGGSKTSGLMLMPSLISGFKELVLIEQSVTGLYERCIDLLTV

SEQ ID NO: 879 - protein, 1356 aa, Butyrivibrio sp. NC3005
MKKDSNYFVGLDMGTSTVGFAVTDENYNLIRMKGKDFWGIREFDEAQTAAGRRQKRTSRRRRQREIARIGLLKEYFHEAISKEDENFFIRLDNSRFFEEDKDSILSSQNGIFNDVDYKDKDYFAQFPTIFHLRAALIEDSVVADNKYSRLVYLALLNMFKHRGHFLGGEISDSGDASIEKIYADFVNISNALVGVSFPENAHGIVTEILADSSISRTEKAARMFEALGFLKKNKIENVIVKGLCGLKIDATKIFEELSEENKIDIDFSDSSYIDREQEICSAIGEEKYELIDLMKQIYDFGILSKLLQGKRYLSQARVDSYEKHKNDLKILKQVYKTELSVEQYDQMFRFIDKGSYSAYVNSTNSSGVIKENEGLCRRSFLGKGRSREELYSKIKKDLKNCSSKEALYVLHEIENESFLPKQLTSDNGVIPNGLHKIEMEAILRNAEKHLPFLLEKDEYGNTVSQRILKLFHFHMPYYIGPVSEYSKTGWVIRKKAGQVLPWNLEEKIDIDKTRVRFIDNLVRRCTYLAGESVLPKASLLYEKYCVLNEINNLRIGGEKISVNLKQDIYNDLFKKGNRLTRKKIAKYLINRGLLDEEDKLTGVDININNSLASYGKFYKIFGEDLEKDSVKENVEKIIYYATIFGDSKKDLEKLLKKDFGDILDSEAIKKICSYKFKDWGRISKEMLELEGCEKGTGEAYTIIQAMWSTNNNFMELVFGENYTFRDELEAKQVKLQKELNSFAPEDLDDYYFSAPVKRMIWQTVLVLKEIRKLMGHDPSRIFIEMTRADGEKGKRTQSRGKQLIELYKNIKNEERDWISEIDKADKDGSLRSKKLYLYYTQRGRCMYTGEPIDLSELFDKNKYDIDHIYPRHFVKDDSLMNNLVLVNKTKNARKSDTYPIERLSDSVYHLWNSLHSQNLITDEKYRRLTCRNPFTDEQKAGFIARQLVETSQGTKAVADLIKQLFSEKTTVVYSKAGNVSDFRNENQLLKSRAINDFHHAKDAYLNIVVGNVYYTKFTLHPMNFIKNELSKDEKKYHYNLDKMFKYDVERNGYVAWRALKEGEKNPTINVVKKVMAKNTPLITRWTFEAKGAIANETLYPAKKAKEDGYIPFKTSDVRLAEVSKYGGFTSVSGAYFFVVEHDDKKKRIRTIESVPIYLKEKIEASENGLLDYCIETLKYKNPRICVPKIRTQSLLEINGFRCRITGRTGKQLYLKSEISLCLDMDWNNYIHDLEKYDNSGIFNKTITKDKNIELYDVLLKKHVNGIYKSRMNAIGGKLESGRDKFIELELDGQCRVLLQMIKISNSEKSANLVDIGASPSTGVMLINKVLKNDCSIYLINQSVTGIYEEKVDLLKV

SEQ ID NO: 880 - protein, 1369 aa, Lactobacillus rennini
MDKPYNIGLDIGSHSIGWTVVDDNSKLVRIKGKLGYGVRLFDEGKTAEERRQFRTTRRRLKRRKWRLRLLREIFEPHIAPLDETFFLRQKQSNLVPTQKKLPQLSLFNDRSDAEFYHKYPTIYHLRNALMTEKRQFDLREIYLAIHHIVKYRGHFLNAAPAASFKSGKFDLENKFDQLNLLFASAYSDLDFTLRTDNVDQVKAILLNEDLSASTRQRQALPLIYQTSADQKAAKKLTKSLATELLKAILGLKAKFDVLTGIETDDTKAWRLTFNAEDFDDKLNELNVTDNEAATQIIEILRELYSSILLAAIVPENYTLSQAMMAKYNAHKQHLSLLRQVKTTLPAKKQKELQAAYDDYIDQHLPLDKFYAKLTKVLPKEKDTDNPQIIQILNLIDLDQFLPKQRTKDNGAIPHQLHQQELDQIIDNQKAYYPWLAQLNPNEKRQKIAKYKLDELVAFRVPYYVGPLIEAKTQQKTSGANFAWMIRKEPGTTTPITPWNFDEKVNRQASANEFIKRMTTTDTYLLGEDVLPKHSLLYQRFEVLNELNGIKIDQKRVTVRQKQAIFNDLFLKQPNVTVKKLQQYLQAKGEYASAPIITGLSDPKKFNSQLSTYHEYKKIFGGLIDDPDKQADFEKCIEWSTIFEDSQILKDKLKEINWLTPEQRHKVANKRYQGWGRLSKKLLTQLVDYNGQRIIDILWNTTDNFMQIVHSEAFDKAIIKENQALLTQYNPQAVIDDLYTSPQNKKALRQILLVVNDIQKALKGQAPSRILIEFAREGQENPRLSTQRKQQVENAYKEASDALLSSAEVRQELKGLDNKALANTRLFLYFMQGGRDIYTGKSLNIDDLSKYDIDHILPQAFIKDNSLDNRVLVSAKMNRSKSDQVPLNDFAEIRYGKQMRQQWEKMLRAGLITRKKYHNLTLNPESINKYTAKGFINRQLVETRQVTKLATNLLVDQYAEDDVQLITVKSNLTHQMREEFDFPKNRNVNNHHHAFDAYLTAFVGLYLLKRYPKLAPYFVYGDYQKGASQNSKWRNFNFLGNLHREKVVDKNTGEIIWQRDAGLGELNRIYNFKKILVTRALRVNRGPMFKQTIYKAEEDKSSGRGSKQLIPTKKNRPTELYGGYTNKETAYLCLVKEPHKKGDIYRICSVLNMWLTELDRIADPIAKAQKLTELLTPQFTTTKKKQGQKIPVVKPFKVVIPKILINQRFFSRGQELTVASPMYMHNEQELFLNKKTIKLLNGQLAKNEAHELAPKIYQQILDQVNDYFPLYDMYKFRDTLNASKEIFVNLPWQDQRQDKKISQSGQKSILNKILIGLHANAARIKLTELNFKSDFGLLSQRSGIAFSPDDQIIYQSPTGLFERRVTLKDL

SEQ ID NO: 881 - protein, 1352 aa, Lactobacillus agilis
MSEKEYHLGLDIGTNSIGYAVMDCNYHLMRAKGKTLIGTSLFREGNTAAERRGYRTTQRRLKRRKRRLKLLEAFFDPYIFEVDENFLARLHEADISPKDENKRFWGSLLFPNEKDANFYRKYPTIYHLRKALMEEDRKFDVRAIFLAIHHIMKYRGNFLSPLSVDSFKQEGLELKEQLDRQLKRVAELYNELNTDVKINVSDVETIQDIIIDKNKSRRDKAGALKKLLAVSSDRKEINKLNASLAKELSNAILGMKAQFANLLLADDLEIDKNKKNFSLLDTNAEENVSGLLELVNEKQAELFDAIKTIHDQIILNEIVPDGKSISQSMVDKYEAHREQLQVLKALYEKMDAKQIKAIKKAYSLYIDGKDPKAKKVDKRAHQNRADFYKEVKKVLVELDDSRAEKLLGLIEMGQFLPKQRTAMNGVIPNQLHQVELDKIIEMQSKYYPWLAEKNPVKSHQKRAPYKLDELLTFRVPYYVGPMVTSKKQQQTSNSNFAWMVRKQEGEITPWNFEEKVDTIASANDFIKRMTAKDTYLVGEDVLPANSLLYQRYKVLNELNNIKVNGRRLPVELKREAYVALFENGDSKTVSAKCFKNWLNVKLKNLNSLKLEGLSTGTKFDNNLSTYHDLKKIFGKAVDDAGRQKDFEQIIEWLTIFEDKKILRIKLKEIEWLTEENITQLTRLNYNGWGRLSRRLLTGICDSNGQRIMDWLWDTTNNFMQIQSQPDFQKAIVEYNSDKLEQGDIEQILGEAYTSPQNKKAIRKVIKVVQDVEKAMGAKPTSISIEFTRSDGRSELTNSRMTQLQKTLMSLSEEMTDQALLAEFKDFQASKKKLTNKYYLYFTQLGRDMYTGEPLNIDQLSLYSDGDHILPRSFIKDDSLDNRVLTKRAVNNEKSDTVPVCEYGAKMKDFWNDLYDNGLISKQKLANLLTDPDEIGPYKANGFIRRQLVETSQVIKLSAEILQTLYQDTKIIEVRQKYTHELREHFNFVKIRQLNDYHHAFDAYLTAFSGRYLYQRYPKLRGYFVYGDYNKFDAKKDRNYLKSYNFLYDLEEGKTDQIVDNVEHKVFMNRQDAINQLKKAYEYKYMLVSQETYTNSGAMFKETIYPVNPKQKLIQKKNDKPVDIYGGYSNNYDAYLSIVRLEDKKGIKFRVVGIPMRNKAELDNLAKEDHNGYMQRLNEIVDEQINSSGKKKTFRIILPKVHFKQLVEDDSGKFMLGSAAYPYNAKQLVLSVKSIESLANKDASDRELVAVYEEILNVVNDKFTLYDARQFRNKLTSSKDKFVELNTADKVTELLDILDGLHANPVVKKLKIISGSPFGFLQRPSGIVLTENAKLIYQSPTGIFERVVYLRDL

SEQ ID NO: 882 - protein, 1078 aa, Lactobacillus ozensis
MHKHYKYALGLDVGVGSVGYALLKLDEADQPCGLLKANSVTFPMSQDRTGNTLASIARNYRSGRRLNRRRKLRKQLVSNLFTKNGLINRNDVYSPYTKHPNFDLYRIWHDSFNQQISNQDLYRLLYYFAGHRAFKSNRIHQLKSSGDKDTTKLLSSIDTNKEYFNNSQYNHLGEMFYCDPKFAQRKHNKGYDDGYLFNIDRGTLLSEIKEILNAQSKFGNPAINDDFKARYLKILSQQRNFDVGPSNPSRFALVDSSGNIKLRNKKDKLNLSFKTSAKASYTFQKFQILQKLANTRYKLNSQSKYQSLNAETIDKIFNKAITKANYKYSQLKKDLKLPDSARFNMVMYETSDDKSAKQAETKTFIIKDNTYYILSKILSDKLQHDYTVIDQIAEILTRYTSDEPKAKALKRQLGEKLSDEKIESLLALNFTQYGSYSIDTMQCLIPYLAKGYDVTTAIDAFNEDQASLENGHSPLIDASMNYHEIISSIKNPALLQSFTKTVKVVKALIRRYGNPYTIHIEMARELSLGNKGKAELIKKQNENRKRNDKVITEMKENFPNVSINGENIIRLKLYHEQNGIDIYDGRMIDYQHVLDNNYEVDHILPYSISFNNSFNNKVLTSSRNNQLKRNRTPYEWLHNDKVRWDTFTSIAENVRNYPKKNNLLKMHYDESDMKKWKTRSLNDTRYATRLLYNYFKHNEQYFDAKPSVMTMNGSMTAQLRYYWGIVKQRAASDKHHAVDACVIATCSNSMVNLISKYHTAREKEQLSSKFPMPWPDFRNDVMNAKQQMNVKRIFSHSIAGKVNEDGLKGARYINTDKVVVIHEKLANLKLKKVGDDYIIVGHGNSRYLRPDDLTSISNRNSKNDLNSVIYDHIYNALSKDKKAFEKQPYLEFEHKGHKYTVRRVKVISDYKGGVILNRDADGNPISVANRGKMVRNDIFKCLDKKERVVYRFVPIYEHQILDTHLPNQYAPFAKNIFVNDKDQFICSLSKGDAVEVKLSTPKKVENCDEPYVCDHFIGYFDGSDISSNRIKINALDNSCSIRASMSKLISIQKCDVTIFGSIHKVHEKVRQPFNLKHK

SEQ ID NO: 883 - protein, 1318 aa, Lactobacillus animalis; identical to SEQ ID NO: 164

SEQ ID NO: 884 - protein, 1368 aa, Lactobacillus graminis
MKRSYNIGLDIGTNSIGWAIVDDQSKLISVKGKYGYGVRLYDEGQTAAERRSFRTTRRRLKRRKWRLGLLREIFEPYITPIDSTFFLRQKQSNLSPKDQRKLYPQTSLFNDRPDADFYQQYPTIYHLRYQLMTEKRQFDIREIYLAMHHIVKYRGHFLNEAPVASFKSSEINLAEHFDQLNTIFADLFRESGFQLETDELVAVKALLMDNQQSASNRQRKALPKLYTPSADKSIEKQRKAIATEILKAILGLKAKFNVVTGIEAEDVKAWALTFNAENFDEELAKLESSLDDNGHEVIGILQELYSGILLAGIVPENQSLSQAMITKYEEHQAHLKMLKAVRDDLATADQQKLKKAYDQYIDGQENTKAYSKEAFYDDVTKALKDYSEQPLVSEIQKLIELDQFMPKQRTKDNGAIPHQLHQQELDRIIENQQQYYPWLAELNPNPKRQTVAKYKLDELVAFRVPYYVGPLITAEQQQQSSNAKFAWMIRKTEGRITPWNFDDKVDRQASANEFIKRMTTTDTYLLAEDVLPKQSLIYQRFEVLNELNGLKIDDQPITNELKQAIFNDLFMQKTSVSVKNIQDYLVSEKRYASRPAITGLSDEKKFNSRLSTYHDLKVIVGDAVDDVDKQADLEKCIEWSTIFEDGKIYSAKLNEITWLTEQQRGQLATKRYRGWGRLSAKLLTQIVNANGQRIMDLLWDTTDNFMRIVHFEDFDKLITEANQMVLAENDVQDVINDLYTSPQNKKALRQILLVVNDIQKAMKGQAPERILIEFARGAQKDKSLTVRRKRKLDEMYSQISDAVLADESVRQELKSSNQDDLVKEKVYLYFMQGGRDLYTGNALNIDRLSDYHVDHIIPQAYIKDDSLDNKALVSSRMNEIKADRVPLQVVQKQFGKNMASEWGYMHRAGLISRKKYDNLMFNPENLNKYQINRFISRQLVETQQVIKLVANLLSNQYEGDNVKIITVKSKLTQTIRSEFDFPKNREVNNYHHAFDAYLTAFVGMYLLKRYPKLSSYFTYGEYLKGNQQDKWSSFNFLNDLKRAKLEDKTNKEIFWHKESGLAYLNKIYQFKKILVTREVHENSGALFNQTLYAAKDDKASGQGGKQLIPAKQARPTALYGGYSGKTVAYMCIVRIKNKKGDLYKVCGVETSWLAQLKQLKDEDSQKAFLKQKISPQFTKAKKQKGTIVKVVEDFEVIAPHILINQRLFDNGQELTLGSATYKHNEQELILDKTAVKLLNGELPLAQSEELAELVYDEILDQVMHYFPLYDTNQFRAKLLAGKTAFMQLPWKSNPDDNKTVQITQPIVLKKILQGLHADAGRVSLKELGMTTDFGMLQKATGITFTPDTQIIYQSPTGLFERRVALRDL

SEQ ID NO: 885 - protein, 1171 aa, Lactobacillus cacaonum
MAKYSVGLDIGISSVGWAIIDIETKQIVNLGSRIFPSGNAAGNQERRGFRGIRRLIRRRKNRLTDLKKLLGETFFSDLKKIDSNGYEYYDIDFQINANPYELRVKGITEKLSKKELAVVLHHIIKHRGISYDLGDLEDDGTSGVSDYKNSININRQLLREKTVGQIQLERLIEFNQVHGQVKKAEDVSLLNVFPSSAYRDEANKIMIKQQEFYSEITNSFMEQVDQLVSRKRDYFIGPGNEKSRTDYGIYKSDGRTLDNLFAELIGTDKINGEKRASASSLTAQVYNLLNDLNNLHVSNTEDGKLTTSTKKEIIKAAKTTDGVFGISQICKIIGCKKEEITGFRQDKSEKKVIHTLAGYRKIRKALATINIEANELNPTVFDQIADILTLNTEKAEIRKQLDKVQLDITDEMKELVIDKNKDFLVDGRATWHSFSYQTLNMLIPELLNTSEEQMTILTRMGLMKSDNEKYRGLKKIPAEKIASEIFNPVVAKSTREAIKVFNAISKEIGKNNIEHVVIELPRDDNEEDEKRKIQKLQKANETEKEAADNLVKHKLGISDSALIAHYRKFKGLSQKVRYWYQQETYCPYCGKIIEATQLINNNDNFEVDHIIPISVSYDDSQNNKVLVHSQCNQAKEKQTPLGWINNGGGFGQSKNEYTNRVKNNKKYSKNKVDNLLNETDLTDIITQRSFIQRNLNDTRYAARTVLDEFYSFFKSNDLPTKVKVVRGKWTSQMRRKWNNVGGLRKTRDTHHHHAIDASIIASFPLLRAFDRAIKLIDVDKETGEIVQYGKASLNGDVIEEKSVIQAPIIKNEKFEKLVDEIYNFPLFKQVELANNIENPENPVKFSHHVDKKANRTVANQTIYSTRIKKTEKIVRKKVTAKEEEYVIGTIKDIYDVTNFEKFKKLYDESSKKDDIKFLMQKNDPKTWEKLVEIMNTYPDYEEISQLDGKVKRVKVSPFKLYFRENGFITKYAKHNNGPKVVSIKYYDSKLGNHIDITPVNANNKVILQSLKPWRTDVYYNNETQQYELLGLKYSDLKFTKGVYGITREAYEKLKYGYTDGVPAWKPISKESEFKFSLYRNDRVRIINEAGEKIDLLFGSRNETSEGYVEMKPIFKTNFDDAEEASFYGKTSNKRLIKKMARKGYQIYKVNTDILGNLYYTAKESNEPKLDL

SEQ ID NO: 886 - protein, 1345 aa, Lactobacillus senmaizukei
MVEKYGIGLDIGTSTLGWTSVDENGKIQRLKGQTALGTRLFNEGQTAEERRGFRTTRRRIQRRRWRLRLLREIFDEPIGSVDAGFFARQKMSSLSPQDDRFEDTYRLFNNQTDKAFHDEYPTTYHLRQALMNSDRQFDIREIYLAIHHIVKYRGNFLRSGKPADFKTGKLDLKEKFEEINADWQTLISEDAPQLPVDDLTTIKAVLVDGSRSRSDRQRGLVKLWMANETVEKNWKPVMTELAKAILGLKTKLYLLTGLDLPKEDQKAWTFSLDTLEDHQGDIDSFFDDHAQQLIDRLAELRAMIQLTEIIPSGLNFSQSMVQRYEAHRSHLEMYKQYALDQTDPKRTKALRAAYNAYIDQHEIADDFYTAVKRVTKDDQSETAEEINRLIGLEQFMPKQRTKENGVIPYQVHQQELDQIIAHQKKYYPFLGTENPVIDHRESQPYMLDELVSFRVPYYVGPMVAANPELKTTENPFAWMIRKAQGEITPWNFDEKVDRKGSATAFIERMKTTDTYLLGEDVLPQQSLLYQRFMVLNELNNIRIDDELLTTNQKQWVFDRVFKGKGTISAKHLQDALKHHGETDGLPKISGLADPTKFNSALTSYRDFQKWLPNDIDRKDRTADIETIINWSTVFEDTHIFVEKLKEIEWLTADQRRRIASNRYRGWGRLSKHLLTEIKDEQGLSIMDQLWRTQHNFMQIVHEPDYAKQIEAANTVGMAKQDIGTVINDLYTSPQNKKAIRQVLAVVKDIQNAHHGVAPSWIFMEAARGADQNPQRSRQRQRQLQDLYAKTAADLVDTEVQQELTDKIKDKANFTDRLMLYFLQNGQDMYSKEKLNIDRLSEYDIDHILPQALIKDDSLDNRVLVHQSINRNKSDTFASEKYGAKMQGAWHQWRAAGLISARKLRNLEMRPDEISKYATGFIRRQLVETRQVIKLVTEILSHQYNPEETKLVSVKAGLSHELRREAGLPKLRDLNDYHHAIDAYLAARIGTYLLKRYPRLERFFVYGQFQTSRLDLRRFNFIHDLVKSKQGVIVDSDTGEILWDRQKDIDYIKHLMGLKHLLVTHEVYDSAAEMYAQTIFKASDNDSKVLIPTKNDRPTAIYGGYTKRRNGYLAILKITEKKAETYRVVGVPTLYMSQLATARSHSVEAEKALLKSLMAPEILSESKVVSFEVVVSHVHLNQLVRDTVFGPAHYFGLGPFRYVRNFHQLVLPFKDQEILVKRTPTDEELNTVFEDICWQVENYFAVFDINGFRNALKKSIDKFEQLPIENVFKDKKLVTQGKKEVLAFVMQGLHANASYRNLKVSLGIKTPLGQLQLTKFMLSRDAELIDESPTGLFRRIRRLKDL

SEQ ID NO: 887 - protein, 1320 aa, Lactobacillus florum
MTEQQRPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDAQFDDQKFHQQYPTIYHLRSALAQPDAPQADVRLIYLALHHMIKFRGHFLNGAAVEKFHGGQLHLEAEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELETQVTQEQRDGLKKAYDEYIDGDKPTIDTFYTNVKKNLDDSELANQIKSLIDLQAFMPKQRSKENGSIPHQLHQRELDQLIEVQGKYYPWLLAAKDKLDALIAFRVPYYVGPMIDPNESDDPQNTKFAWMVRKEAGEITPWNFEEKVDKTGSATNFIKRMTTTDTYLLGEPVLPKNSLLYQQFTVLNELNKLKVDGKALTVDQKKYLYEHVCKKQRRVTLKKLSDCLMARGDFPMGAIFTGTTDQKNMNNTLKTYQDFQEIFGDEIDNPDRQVDFEKMIEWSTIFEDREIFKLKLAELNWLTSEQLERVSKKRYQGWGRLSQKLLTHIVNENGERIIDQLWNTNQNFMEIMGQDGVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQSENRVHKEDRLPGETVANKMRPTWKMMREQGLMTQRKYNNLTLKPDQISKFNNRGQFINRQLVETRQVIKLAADIMNQKYQADQTKVVTVKANLTHHMREKFNFYKSRNVNDYHHAFDAYLTVFVGNWLLKEYPKLQPYFVYGDFAKTGTNNLKSFNFLYRFERDHKLNDKGAIDTDKDQQLGYMKRIYRFKKMLVTKQLETNEGALYKQTIYKAPANEKNTKKNRSLINTKKNRPSDIYGGYSQSVTAYMSLVFFKNTFKLIKMPLVAANAIKNSLSSYHDTILKILGSNEFKVLIPKVKMNQLIKEGDSLYTVVGVYKHNAQQLILSDNSMGIITKPIREICDSDLDSVFNELVDNIDKYLNLYKIEDKLTIKEKFYALKNKESKFKCISDILVGTHCNAGRSNLKIIGLSSYWGMFSGNNDGLKINENSQLIYQSPTGLFEHRVKVSDL

SEQ ID NO: 888 - protein, 1402 aa, Lactobacillus floricola
MTYRNYHIGLDIGTSSVGFAVRYDNGELVHKKGSNLVGARLFKEGETAEERRLNRGARRRYNRRKWRLNLLNQIFKPLIEVNDPTFFKRLEQSNLVNYDKSESFSLLNNQSDDKLHQQFPTIYHLRDYLMKSTEKADIRLIYLAVHHIVKYRGNFLDASPVDSFEASNLKVDEILTQINLLLDNLTDDLRLNTQYVTDIEQTLLSNTESNKDKEKVIQKLLLHKEAIKIDKDRTAQIAKLVLGYKADIAKLFGITEKLQTPKLELSAANSDDALMELSAELNEDQIGILLQLKTLYSRVRLNQIIPSGTSLSKSMIEKYELHHTQLKSFKENILLKLRRNTAVRRNLELAYALYVGNAQTKQEVFEPKKARFTSDDFASLKANAKSASSVKEAPKNTKTKLTTDDFYNILTELFATFESELSADEDMIKEVEQIKKAITGDNYLPKQRTDQNGNIPHQLHQIELRQILQNQLPHYPEMDKINEQKPIEKLVTFRVPYYIGPLITPEDQQKSSAANFAWMKRKEQGAITPWNFDDKVDRMQSATNFIKRMTVKDTYLINEDVLPDRSLLYQRFKVLNELNLVKVNNQLLSIGEKQAIYHDLFEKQKTVSTKKLQSYLQSEQGYGDNIEISGLSNPDKFNNGLTTYIDFKNIFGDLVEDTTKQKEFEQIIEWSTVFEDRAIFKAKLQEVNWLTEEQIKALVAKRYSGWGRLSYRLLAELVNDNGERIIDILWNNKGSNLMSIVSQDEFQQQIARINSHEVQELGMESVLANAYTSPQNKKAIRQVMKVVDDIQLAMNGQAPTSISIEFTRKPEENSEISKSRYETITSIYQSLSKDIEKEVKDNLNKNKSSLKKNLSDKYYLYFTQLGRDIYTNQPIPFNEIPYYDIDHIVPRSVEMNDSLNNRVLVAKSINQIKKNNAPIDSSLKITSETRQLWKKLLDSGLITKQKYYKLSSSIKNTVSPYVKQGFINRQLVETSQVIKLVANILGTKYQNDDTEIIEVKAHLNSEIRKTFEFYKLRELNDYHHGFDAYLTTLVGGYLYNRYPKLRSYFVYGDHKRLDKAQLSELKNFNFLHGLTNPKSGSDGLITASGSQQVVLDRNETIKRLNKIYRYKYMLISREVFTKQGQFYNETIYPAKPNTAKMIPLKDNKPSEVYGGYSSSNVSKIALIKEKNTDNYQFIGIPIRSIAKLKQAKANSKTVYQTELNRVIKSVLASQKTKKQKEFEVILDNVKYNQVVVDQGEKYYLGSPYYKKNAKQLVISPESVKILADKATADLPEQEAHNKLMTVYQEIVDVLNKHFALYDINNVRKKLNDGLIKFSQLPNYDETSKNRFDISKSIKTKYAVIMRILSGIKNQTSEVPELGLKSPLNKMQTKGGIKISPEAKIYYSSPTGIFSHFKQVKNL

SEQ ID NO: 889 - protein, 1346 aa, Lactobacillus floricola
MNQTKNYDIGLDIGVGSVGWTITDSQSQKVLKVKGKQGIGVHLFNEGQTAEERRQFRTNRRRLKRRKWRLRLLRELFDEPISSIDPEFFARLKYFNESSKDPKNKGYQPQLHDDLKDVDFYRQYPTIYHLRHALMTQKEKFDIRDIYLAIHHIVKYRGHFLMNGHSSSFSVAQTDWKADLTKLFELIQETRTNLDFSFDLTEIDTIKSLLFDKNLSRNDRQKEIVGLINNNSQLDKKDKALTKQLVESVVKGIVGMKTRTDILLGYEVDNKEQSKAWNFSIDELDDQMATIDPALSQNSQAHDIITLIQKLYMTVQLAQIVPEGQSVSEMMINRYNLYAEQLQQLKDYKKINLETGLLLREAYDELMTKALTAAPGKTIHDTFYNKVKKILKDQDNKQALSIKQAIEDSNYLIPLRIKSNGVIPYQLHQRELDAIIENQKEFYPFLATPNPVDGHQEALPYKLDELIGFKVPYYVGPMVDPEVDSDQNFAWMVRKEKGEITPWNFHNKVDITQSADNFIKRMKTTDTYLIGKDVLPQNSLLYQRYTVLNELNGIKVANKKLTIEQKQRLYDQLFKKKKTVKKQDILNNLVAAGEIHEDDNLTGLSNGTTFNNNLGSYIDYCKIIGQDKLEDASKQADIERIIEWSTTFEDANIFLTKLAEINWLTEDQRQKLSQIRYRGWGQFSKTLLTDIKDNKDNSIIDNLMSTKKVFMQIINDTTIKQKIDDYNQYHLNHADLKDTIANLFTSPQNKRAINQTLLVIEDIINAVGHKPNRIFIESAKDNRNAKNQLTQSRLKRIVKQFEDNKQHVDQSVYEELKQLDDGSHASIDDRLLLYFLQNGKDMYTGQPIDISQLSTSQYHIDHILPQAKVMDNALDNRVLVSSKANTEKSDRFLSEIPQFQQRSLWAELERMGFLTKAKKERLLMTSDEFKQNSVRFIARQLVETRQIIKLVNQLIIQEHPEVKLVNIKADLTNAFRKKFNFVKNRNANDYHHAFDAYLTSLIGSHLLKSHPKWEPLFVYSDYDKIKFDNAPQGVNIMKEFEQSKLADENGEIIWNKDEMMAYLERLYNSRQILITKKVYARHGNLFKQTIFKAGESDNLIPVKNNRSDIAIYGGYKSKQVSYYALISLHNKKRQKRLVAVYLIDIQKLQNLNESDYFKTLHTIIKERHNIKPEFDILADKIYQNQLIIDNKNGSNRPFRIEGDFKNDRQLYLPLQYQRWLASKEPTDEKLNRIFDHICEQLADYFPLFAGNACDKLLDNRDKFYQLSIKSEFNDKGKLIAEGKLSVIDKLLVAMHADSRNSNLAVIGLSSSWGRFKLHGGNEAIGTSVQLIHQSPTGLFKRIQRFN

SEQ ID NO: 890 - protein, 1354 aa, Lactobacillus coryniformis
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 891 - protein, 1128 aa, Lactobacillus tucceti
MDRKISLGLDIGVSSVGYSVIDVDTGKVLELGSRLINGKIGTENQARREMRGTRRLINRKKQRRKDTVKLFNEFKLIDSKKDEHYFDHFANNSDPYELRVKGLSEKLSLSEIADGLYHIVKRRGISYDLKDADEESEGSEYENGLKINNSELKNQTPAQIQLKRLNEYGAIRGKVVIDEEKILLNVFPTKAYLDEAKRIIEKQREFYPGILTEEFEEKYCQILTRKRDYFVGPGSEKSRTDYGIYKEDGRTLNNLFEELIGHDKIYPEELRASGASFTAQLFNVLNDLNNLHISSYEDQKLTTENKEQIISELKSTTSNVNMMKLIQKIAGCEESDISGYRTDKNYKPEISSMRIYRKVHKKLLESEIDITNWPDDFINKLSFILTLNTENGEIRNQLKNRLQPEYDFLTDELIQTIIDNKESFDIKSNNKWHRFSIKTMELLIPEMIKRPVEQMTLINEMGLIKNSGKKFSNYKYLPYKKIAEDIYNPVASKSVREALKIVNAILKEYGHIEYIVVEMPRDKNEDEAKDQIEKFQKANGRLKDAALEEFTEAIGDKSTVDKKLGVHRSKLLFKIRLWYQQRGMDLYEGKPISAVDLLNNPDSFQIDHIIPQSVSFDDSFNNKTLCNSGLNQIKDKKTPFEYMNEGYGQGFDSMKAMVMKNPRIDHNKRKNYLFSENVSDIETRKRFISRNLVDTRYASRVVLNNLQEFFKEKESDTKISIIRGKFTSNLRKHWKINKNRDTYHHHAIDATIIAATPFLNIWKKGSSIFPSNVESEDFFDIKTGKIIGNDEFNKYAYDEPYNGFYNELRNATDRIKFSHQIDKKMNRKVSDSTIYSTRVAKSPKNKKESEYIVAKIKNIYDADEYAKFKRIYDKDKTKFLLNKYDPRSFNHLEKIMNTYPDSIERTMSNNKVKVVRISPFELYRQDHGPVKKYSKKNNGPEIKQLKYLDKKVGSSIDVTPDNAKNKHVILKSLKPWRTDIYLNHETGEYEIMGIKYSDLKFNKGEGYGIKKAKYLEIKHREKVSDDSEFMFTLYKKNRIKVENMETDESVEMLFWSRTMDSQKGYAELKPIYKYKTEDDNWPIYGNAKKQIIKKLIPKNCKIWKVNTDVLGNPFYVEKEGEYPKDVLD

SEQ ID NO: 892 - protein, 1371 aa, Lactobacillus buchneri
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLIDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADYDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 893 - protein, 1129 aa, Lactobacillus futsaii
MADRISLGLDIGVASVGFSVLDIDKGKVIELGSRLFNATVAEGNQDRRSMRGARRLLNRNKQRRQDTGKLFQKFGLLDNFNKDNFYDTFNQNWNPYELRVKGLTEHLTKKELAESLYQIVKHRGISYALKDADADEGGTDYSASLKINSQELAEKTPAQIQLQRLNDYGKVRGQVVIGDDPDNQKVLLNVFPTSAYEKEAKQIIATQKQFYPEILTDEFTKEYCKILTRKRDYFVGPGNEKSRTDYGIYKTDGRTLDNLFEELIGHDKIYPDELRASAASYTAQLFNVLNDLNNLRILSYEDGKLTKEDKEKIIAEIKSNTTTINMLNVIKKVAGCSKEDIKGFRVNEKDKPEISSMAVYRKVHKDLLKVGVDISDWPVEFIDKLSFILTLNTENGEIRKQLNNRLVPEFDFLNDDLIQLIIDNKDSFEIKTNNKWHRFSLKTMNKLMPEMLERPVEQMTLLNEMGLVKKDKKRFENNKYLPYKEIAKDIFNPVASKSVREALKIVNAVLKKYGHIDYLVIEMPRDKNLKEEQDNIKEFQNKNKKAKDAAFEAFVKSVGSEQRVKEALSKNRKLQMKMRLWYQQQEIDPYNGETIDATDLINNPDKFEIDHIIPQSISFDDSINNKTLCFASMNQVKGQKTPYEFMLEGHGQGYDKFKATVLDNKNFDRNKRKNYLFEENVSDIETRKRFLSRNLVDTRYSSRVVLNSLQDFFHEKSADTKVTVIRGKFTSNMRKHWHIDKTRETFHHHAIDASIIAATPFLRMWKKGGTIFPVKVGEESIDIETGEILDDKKFDKVMYEEPYNGFVSEIMNADDRIKFSHQVDKKMNRKVSDATIYSTRTGKLAKDKKDAEYIVAKVKDIYSVDGFKKFKKVYDKDKSKFLLYKYDPRTFSELERIISDCPDKVEKVQTNGKVKAVDVSPFEMYRRYHGMIKKYSKKGNGPAIKQLKYLDKKLGSHIDITPANANGKHVILQSLKPWRTDVYLNHETGEYEIMGIKYSDLKFNKNVGYGIKKDKYLEIKKNEEVSEKSEFMFSLYRKDRVRIQNMKTGESVELLFWSRNFSNKKYAELKPIFKFVTEDDDWPVYGHAKTQILKRLVPKDCKIWKVNTTILGDPYYLEKESDNPKDILD

SEQ ID NO: 894 - protein, 1376 aa, Lactobacillus namurensis
MDKKYGIGLDIGTSSIGWTVVDKYGHIIRVKGQTGIGVRLFREGQTAAERRTFRTTRRRLSRRRWRLRLLREIFDEPISAIDENFFARQKASSLAPGDARYQQAFQLFNDRTDQAFYCKYPTIYHLRQALMTESRQFDIREIYLALHQIIKYRGHFLLGGAAKDFQSDKLDLEAYFTTINAQLAGIYSDGSVQLPTLDWNQACQELTDTSRTQSDRKNWLVKELKSYGDSQLKPIYTQIANAILGFKTDLAKIMGINDPEKALSFNLDALDDHRDDVAELLTDEQIPLVNLLAKLHTALELAAILPDGQTLSGKMVEIYETHRKQLKTYKAFIRQLPDRQQRLALKQAYDHYIDQGLNREAFYSEVKAILEKQKPLTATGQAMKKAMDQNAFLLKQRTKTNIAIPYQVQQQEMDQIIANQSKYYPWLATPNPVKSRRVIAPYKLDELVCFRVNYYVGPLVQSKPGEATKEAKFAWMTRKDPQSTVAITPWNFDQQVDRQASANAFIQRMKTTDTYLLGEDVIPKNSLLYQKYEVLNELNNVRVNGDWLDPQRKQYLFKKLFMDQPQSVVTVKALQKTLVVIGACPTLPTVEGLANPKRFLSQLTTYHDFCKLLPDDIQRADRQADIEKIINWSTIFEDTAIFKEKLRDIKWLSADQIRRLSSRPRYRGWGRFSAKLLCGLHDRQGNTVMDELWQTSRNFMQIIRQSDFQTAIAAVNQQDLGRQDLQRVIDDLYTSPQNKKAIRQVLAVVTDIQKAMHGKAPSWLFVEVAKGAQKNPQRTQSRQSKLAEAYRESARELVDEAVKEQLLTLPDDRQTFSDRLVLYFQQNGRDIYTGEPLDFERLSNYHIDHIIPQAVVKDDSLDNRVLTSNQANLEKGAHVPTIFRDKQEPVWQELYRVGLISHRKLRNLLTTPDDLDDRGRATGFIARQLVETRQVIKLVMEVLSQYYDTTETELISIKAGLSHQFRQELNLPKLRALNDYHHAQDAYLAARIGTYLLQRYPNLKRFFVYGDFKKTHFDLQRRFNFIGGMISREKQPYNLIKNPVTHQVIWDEEMEIGDCQKKNPEQPKHDATVKMMNLTKIMNLKHILVTHEVYENHGALFNQTIYPASQAHKKKLIPQKTEKPIELYGGHSSEQAGYMAIIRLLGKRPGYKVMRVPVRYVSQLQHQDVAEQKKLLYKIFVSELTSRNKVKPFEVVVPHVCLNQPVEDMIKGQWHRFALRTNGYYQNQQQLILSLVAQRTLAGYKPKDDELMAVYHEICKQVKYYFPLYKMNKFQSRLFAAEELLQKRSTVNSFSITIGKNGKENKTLNLGKRELLLRLLGGLHANATRVDLKDIGCTGQFGQLQVKNGIKLTEQAVLIHESPTGLFHRRVRLNDL

SEQ ID NO: 895 - protein, 1078 aa, Lactobacillus acidifarinae
MGYLIGLDIGITSVGYAVLQTDFKGNPYKILLMNTVIFPVAEAPKTGESLAAPVRQKRSSRRTNRRTKFRKLRVQKLFVRFGLLESADVATFLNQKVPHQDIWQLRKDALNRKLSNRELFEILYFFVGHRGFKSNRRSEVTGKQPKDNQVVLTSIHDRGNTLNDFDSLGEMMQELPEFKTIKHNKAYRPDNTIYPLRAWIEHELSAIFSVQQKNNRQITDNFITQYLDIFRSQRDFDQGPAAPSRFGGNMIERMVGPDSLDAHEKRAAKLTNTFFRFNFLSTLNNLKIQLTLGAEFHPLTTPQREIVLQAATLKSLNYKQIRHKLQLPDSARFNLVPYQSNEDPIKTESKHYLFKRKALTQIEAVTDNPQLIDKIGTILAYFKGDKTRQEKLSALNLSRAEIKQLLPINQPGFGNLSLKTMHKILPYLEQGHLYHEAAQLAGYDFQNNLVDRQYLRDNLKNPVVNRAIGKTIKVVNAIIKKYGDPDAIHIELTREIKHSHEERQKIARQMNTNMDQNDKVAEHLRENGIPVNGQNIIKSKLFYEQKGIDLYSGQQINEQDLYTEDHYQVDHIIPYSISFNDSFTNKTVTRTSNNQNKANRLPLEYLSEEKQDAFRARVMSNISNYRKRQNLLKEGITEDNRQQWKTRNINDTGYINRLLSQYLRNNVQFTKKSHNPVFTVNGATTAYIRKRYGIIKNRQATDLHHAVDAVIIGCISNTFVSRLAKYSEAQEARYHKQLWQITQYRQEHKDLSTIEYQELIKQFPLPWPDFRHELMARLSTDPAKMMAHHTWEHYTDEEISQLKPAFVIRSANHKVTGSAHDDTIYSKKLYDQRGVGLLRTSLQNLKYDSKKDGIKNYERLKDGSNSLVYDSLLRALKEHDGNAKKAFPDNQLLISTGNHQQIITHVKTVKKITHPIEVNRDTAIAIGGRMIRVDIFKQAKAQKLIGIPVYVNDTVKPTLPNRACTSGKRYSDWYQLTRQDQFLCSLVSNDLVLVETASPLKVTNNITNEEVQTTQLLCYFSSFNIANAQINFHSINNDSSINPIVLNKVTYLTKYQLDYLGNYFPVKHESRKTFNRKR

SEQ ID NO: 896 - protein, 1351 aa, Lactobacillus zymae
MYKKYGIGLDIGTSSIGWSVVDEYGHIIRVKGQTGLGVRLFREGQPAADRRTFRTTRRRLGRRRWRLRLLREIFDPYIAAQDPNFFARQKASAIAPGDSRFKAVYRLFNDQTDRQFYDKYPTVYHLRQKLMTEKRQFDIREIYLAVHHIVKYRGHFLTGGAAKNFKPGKLDLNTYFATINAQLAAIFMDSQVELPQLDWDAVVSLLTNDQESPSDRQKALTKMLVAQGDATQKRFYTEFSKALLGLKAKLYVLTGFEGDKTDQKALTLSLETLDDHQDDVTQLLGDEQRQLVELLARVQSAIQLAIIIPNGKTFSGQMVQQYQTHYDQLRLLKDYREQLTDQKHRRALKQAYADYLANDQDQDALVKAVEKVLKQNQPLSTVGVRLQTAIDAGDFLPKQRTKANSVIPHQIHQQELDRIIEAQSVYYPWLAEENPVAAHRSYAPYKLDELVDFRVPYYVGPLVQPQADKAAKETKFAWMTRKEAQSTTPITPWNFEQEVDRNASANAFIQRMKTTDTYLLGEDVLPKNSLLYQRFEVLNELNNVRVDGKLLTIAEKQRLFQDLFVDRSQASVTIAQLQANLIAHGAAKDRVEIKGLADPKRFLSSLTTYHDYAQIIPEALEQPDKRADIEKIINWSTIFEDTSIFKEKLQEIAWLTPDQRRQLSQKRYRGWGQLSDKLLTQLRDATGQSVMDLLWTEPNNFMQIIRRTEFQQAIARVNQTDLKQQDLATTINDLYTSPQNKKAIRQVLLVVADIQTAMHEVAPSWLFIEAARGPEQNPKRKLARQQQLLEAYKTSAKEIVNEAVKEKLLSAIDDHQKFEDQVVLYFQQNGLDMYTGKPLDFERLSKYHIDHIIPQSVVKDDSLDNRVLTTPEENERKGARVPGPLYASQQGRWRLLQRAGLISQRKLDHLLLRPEELDQQATGFVARQLVETRQVIKLITNILSQQYDPEQTKLVSVKAGLSHQFRTRLNLPKLRELNDYHHAHDAYLAARIGTYLLQRYPNLERFFVYGQYQKTRFDLKRHFNFIGEMLKGKPEDAVIVKAPHSETVIWDKQDEVKQLKKIMEYRHLLVTHEVYDNHGALFNQTIHPAKNPKNRKLIPRKTTQSTELYGGYSGETTGYLAIARTVTKNKISYQVLRVPTRLVGRLQRSSESAQRQILTDWFAPSFVSRGKQQPFEIVLRHVFKNQTVIDDIHEQSHRFGLRSDTYYCNQQQLVLSLEQQRMIIDQKLNNTNKLMVVYEAVCDQVAKYFPLYRMNHFKESLLEAGPKLAELPINTVQSKNGKLKLGQRSVLLQTMQGLHANPETKDLSIIGCPKYFGKLQVSSGIKLTENAVLIHESPTGLFQRRVRLSDL

SEQ ID NO: 897 - protein, 1363 aa, Lactobacillus hordei
MENNRYNVGLDIGTSSIGFAVTDEQDELVQVKGKNYIGVRLFKEGQTASERRSFRTTRRRLKRRKWRLGLLEEIFAPYLAQGDPYFLARMKESNISPRDERKKYYGSLLFSDDTVFYDKYPTVYHLRHALMTEDRKFDIREIYLAVHHIIKYRGNFLINTLINEFSSKAVDFKKDADILNDLFEQFYISDINDSFQLNTADMNEISELLLDNSKTRLDRQRESLKKLAKKVDDISVAKKHQKIATEFSKAILGNKAKFDVILNVTTDSSNDWSFKLEDEDADEKIVVLLEELNTPQQEALNIIHQWYSQISLNGIVPDGKSISEAMISSYELHKEHLALLKQQINNTKDKKKAHGLHEAYNEYVHGNNNKKLNQADFYSKVKQNLESSLITDEILELINAENFMPKQRTSANGVIPHQLHQQELDRIIQNQAKYYPFLAETNPNEKRSKVAKYKLDELVAFRVPYYVGPLITATDQKKTSGKEFAWMVRKQPGRITPWNFDEKVNKMESANTFIRRMTTKDSYLIAEDVLPDESLLYQKFKVLNELNNLRADGRKLKVSVKQKVFKELFQQQKTITIVKLQNYLKAECSFLTTPEISGLSKPEHFVSSLATYIDLKKIFGEDIDNPARQNDFERMIEWATIFEDKNIYSEKLNEIKWLNDRQKKELKNKNYHGWGKLSAKLLKGLRDSDECSIIEHMWNTQQNFMQVQAEEDFAQRIQEENNQHLKGNTLEEVLADAYTSPQNKKAIRQVVKVIEDIQKAMGGIAPQKISIEFTRAPEEKPRRSVERQQQIEKIYKSVANEVENAGVKDELQRFSDRKQTLTDKYFLYFTQLGKDMYTGKSINIDQIGNYQIDHILPQAFIKDDSLDNRVLVSAAVNNGKSDNVPTKNDRYKVREHGQRLYDQGLISKRKFNNLITDPDSINKFTARGFVKRQLVETSQVIRLVAEFLYNKYQSKSEIIEVRAKMNSQLRKDFGLIKNRNVNDYHHALDAYLTTFIGNYLYRRYPKLRAYFTYGCFKKVDDSQLKYFNFLHDIEDDKKKIIKDNDTGEILWHRDEGIARFKRIYNFKYMLVTHEVLTRQGAMFKQTVYSAAVAGSKKLIPVKEDRPIDIYGGYTNNNDAFLAIVKVTKKKQYMVVGIPQRAVVKLNDAAKQGSKAYQKVLYNVIKPQFIKKKKDRKTGKITQKLENFEIVVSKTLYRQLIIDGDQKYMLGSSAYKYNAKQLVLSEYALEVLDRSIFEKKEYTTVDLDNVYDEILAQVDKYFSLYDKNKFRQKLHESRKIFTELPINNLFSGTKLLKSGKRETLNEILEGLHANATKKDLKSLKFSTPLGMIQYPSGIILSENAILCYQSPTGIFERRVTLKDL

SEQ ID NO: 898 - protein, 1170 aa, Lactobacillus hordei
MSKYNVGLDIGIASVGWSIVDADKKKIIDLGSRIFSSGNAAANQERRGFRGTRRLIRRRKNRLTDVINFFGEKKFIDTKVVDKNGHVHYKFSVNNTESPYELRVKGLSEILTKQELVIALYHIVKHRGISYDLGDLEDDGTSGVTDYKTSININRQLLNEKTVGQIQLERLNEFGKVRGQVEENENVTLLNVFPSAAYVKEATQILTKQREFYPEITDDFIAKFMLFITRKRDYFVGPGNEKSRTDYGIYKKDGRTLDNLFDELIGIDKINGEKRASASSLTAQIYNMLNDLNNLTVPNTEDGRLTIQTKKEILEAAKTTNGLFGIAQICKIIGCKKDDIKGFRIDKSEKKIMHTLSGYRKFRKELADVNIEANDLNINLVNKIADILTLNTEKAEIRKQLDKSNMDISNEMKEIVINKNKEFLVDGRATWHSFSYKTLNLLIPELLNTPEEQMTILTRLGLVKPNNKKYEGLKNIPARRITEEIYNPVVARATREAVNVFNAITKKVGRDNIKDVIIELPREDNEVDIKKGIVKRQKQNEVEKETADALVKQHMTISDSALIAQYRKIRGLSQKVRYWYQQDTICPYCGKKIEAVQLINNNDSFEVDHIVPISVSFDDSQNNKVLVHSQCNQAKEKQTPLGWLNNGGGFGQSKADYIARVKSNKNYAKNKIDNLLNETDLNDIATQRGFIQRNLNDTRYASRIVLNEFYSFFRSNNLSTKVKVVRGKWTSQMRKKWNGVGGLSKTRDTYHHHAIDACIIACFPLLKAFDKAIKLIDVDGETGEILQDKKAIKLAQEAEIVEKISVIKNKKFENMVNEIYNFPLFKQVELANDITNLENPVKFSHHVDKKANRAVANQTIYGTRIKEKEVTKRGKKEKIQERYTLGTIKNIYDIDGFMNFKKLYDKISKNDDVKFLMQKNDPKTWEKLIDIFNSYPDSEEVTQVDGKVKRVAVSPFKLYYRENGFITKYSKHNDGPKVVSIKYYDSKVGSHIDITPKDARNKVILQSLKPWRTDVYFNSITQQYELLGLKYSDLKFTNGVYGITRDAYEKLKHGVSEDGVTAWKPISKNSEFRFSLYRNDRVRVIDEKGDSIELLFASRTTSNEGYVELKPIYKAKFDSKEEVGFYGLVSNGRLIKKMSKGGYKLYKVNTDILGKPYYVTRESDEPKLSL

SEQ ID NO: 899 - protein, 1395 aa, Lactobacillus otakiensis
MVISSCIIGDVPKGVTGQHYFEEFYRMKVNNYHIGLDIGTSSIGWVAMGEDGKPLRVKGKTAIGARLFQEGNPAADRRMFRTTRRRLNRRKWRLKLLDEIFDPYITPVDSTFFARLKQSNLSPKDSRKEFKGSMLFPDLTDKQYHLDYPTIYHLRHALMTQDKQFDIRMVYLAIHHIVKYRGNFLNSTPVDSFKASKVNFDDQFKKLNELYTAINPEESFQINLANSEKIGQQFLDPSIRKFDKKKQIPKIVPVTMDDKAVDKLNGKIASEIINAILGYKSKLDVAVQCDPEDSNPWAVKFDDEDIDAKLQKILPEMDENQQSIIGIIQDLYSQVTLNQIVPNGMSLSESMIKKYNDHHDHLKLYKKLIGQISDSKKKTALKKAYDQYVGNDGKVIEQDDFYSSVKKNLDDSELSKQIMDLIDADKFMPKQRTSQNGVIPHQLHQRELDEIIEHQSKYYPWLAESNPNKHDLHLAKYKIEELVAFRIPYYVGPMITPEDQKKSGAAVFSWMKRKEPGQITPWNFDEKVDRMESANKFIKRMTTKDTYLIGEDVLPDESLLYEKFKVLNELNMVRVNGDSLKVADKQAIYQDLFENYKHISVKKLQNYIKGKTGLPNNPEISGLSDPDQFNNSLGTYNDFKKLFGDKVDDPDLQNDFEKIVEWSTVFEDKKILRAKLNEITWLTDKQKDDLESSRYQGWGRLSKKLLTGIVNDQGERIIDELWNTNKNFMQIQSDDDFAKRIHEANADQMKSTNMEDVLADAYTSPQNKKAIRQVVKVVDDIQKAMGGVAPKFISIEFTRSEDRNPRRTISRQRQLENTLKDTAKSLVKSMNPNILSELDNASRSKKGLTDRLYLYFTQLGKDMYTGEPINIDEISNYDIDHILPQAFIKDDSLSNRVLVSKAVNNGKSANVPLKLFGAKMGHFWKQLAEAGLINKHKLKNLQTNPDTISKFAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQARIADTETGEVIWDRETSIKQLRDVYHYKFMLISQEVYTLRGAMFNQTIYPASQAGRKKLIPMKADKPVDVYGGYSGSTDAYMAIVRIHDKKGDKYKVVGVPMRALNRLNTAKNVSDAKYDQELKEVLTPQFTKSKKNRKTGEITQTVEDFEVVLGKVMYRQLVIDGDKKFMLGSSTYQYNAKQLVLSDESIKTLASEGKLNEAQESAAYDKVYDEILDKVNKYFALYDTNKFRQKLSLGKDKFVGLPNHNVFDGSKKISSGKREILNEILNGLHANATLGTLSDIGFSTPFGKMQQPRGIGLSSNTSIEYESFTGLFKRTIFLKDL

SEQ ID NO: 900 - protein, 1368 aa, Lactobacillus kefiri
MRVKVYYIGLDIGTSSIGWVVMGEDGKPVRVKGKTAIGARLFQEGHVAADRRMFRTTRRRLNRRKWRLKLLDEIFDPYITPVDSTFFARLKQSNLSPKDSRKEFKGSMLFPDLTDKQYHEDYPTIYHLRRALMTEDKKFDIRMVYLAIHHIVKYRGNFLNSATVDTFKASKVDFKKSFNQLNELYSAINPEDAFQVDMNKSDETGRLFLDSSIRKFDKQKQISKLIPVVVEDKEAKKLNGKIALEITKAILGYKSKLNVVTQTEPEDPKKWAVKFDDEDIDSKLNDILPEMDENQQSIVEIIQDLYSQVTLNQIVPNGMSLSDSMIKKYNDHHEHLKLYKKLIDNISDTKKRSALKTAYDKYVGDDGKTIEQDEFYSNVKKNLDDSDLSKQIADLIEAEKFMPKQRTSQNGVIPHQLHQRELDEIIEHQSKYYPWFAEANPNKHDLHLAKYKIEELVAFRIPYYVGPMITPEDQEKSSQTIFAWMKRKEPGQITPWNFDEKVDRMESANRFIKRMTTKDTYLIGEDVLPDQSLLYEKFKVLNELNMVRVNDHPLKVSEKQAIYRDLFENQKRISVKNLQNYVKSKSGLPTGPKISGLSDPDHFNSSLGTYNDFKKMFGDKVDDPDLQDDFEKMIEWSTIFEDKKILRAKLDEVAWLSDTQKNEFKEIRYQGWGRLSKKLLTGIVDGNGQRIIDELWNTNKNFMQIQSDDSFAKRIHEANANQMKATDVEDVLADAYTSPQNKKAIRQVVKVVDDIQKAMGGVAPKFISIEFTRSEDRNPRRTISRQRQLENTLKDTAQALVKSINPDILSELDNASKSKKGLTDRLYLYFTQLGKDMYTGKPINIDEISNYDIDHIFPQAFIKDDSLNNRVLVSKAGNNGKSANVPLKLFGAKMGGYWKQLADAGLIGQRKLKNLQTNPDTISKFAMHGFIRRQLVETSQVIKLVANILGDKYRNDDTKIIEITARMNHQMRDEFGFIKNREINDYHHAFDAYLTAFLGHYLYHRYIKLRPYFVYGDFKKFREDKVTMRNFNFLHDLTDDKQERIADTETGEVIWDRKRSIQQLRDVYHYKFMLISQEVFSLNKEMFKQKLFPATLAKKSKLIQIKKDKPVDIYGGYSNNTDAYLTVVKLKGSKEDKYKIVGVPMRALDNLKHAEKESPQSYTAELRKALEPQFTKIKKNRKTGEVSKVVTNFDIVLGRLFYRQMVIDGSEKSLIASSVYQYNAKQLVLSDQAIRTISDQEGIDEFELSSQYDKVYDEIVQKVEKLLPIFQHRHFQERLNNGKSLFVNLPVHDVYEGNKLEQVGKKHIINSILGGIHANADRPDIDLFGIKNLGQFSSTSGINLSSDAIICYQSPTGLFERRVVLKDL

SEQ ID NO: 901 - protein, 1364 aa, Lactobacillus fuchuensis
MNKRYNIGLDIGTNSIGWSVVNDQSQLVRIKGKLGYGVRLYDEGQTAEDRRLFRTTRRRLKRRKWRLGLLREIFEPYITPQDATFFLRQKQSNLSPKDLQKQQPQIGLFNDRLDSDFHYQYPTIYHLRYALMTEKRQFDLREIYLAMHHIVKYRGHFLNAAAASSFKSGEIDLAKDFAALNQIFGTIFSEVGFSLSESNLDEIKSILLDNNLSASVRQRKALPLIYQTAASKDSEKQYKAIATELLKAILGLKAKFNLITGIEVEDVKAWTLSFNAEDFDAKLSDLNIADNDDAVQIIEILRALYSGVLLTGIVPEGQSISQAMIDKYEAHKAHLIMLRSIREQLSDKENKALEKAYDDYIDHPEDKQHGSREDFYAAITKVLKKDSEDTNIIEILKLIELDQFMPKQRTKDNGAIPHQLHQQELDQIIENQKQYYPWLADINPNEQRQKMAPYKLDELVTFRVPYYVGPMITAEEQFQTSNKKFAWMIRKEPGAITPWNFDQKVDRQASANEFIKRMTTTDTYLLAEDVLPKQSLLYQRFEVLNELNGIKIDDQPITVEQKQAIFNDKFMQQAHVTVKNIQAYLVSEGQYASRPNITGLSDGEKFNSSLSTYHDLKKIFGDMIDDPNKQTDFEKMIEWSTIFEDGKIFADKLREINWLTDEQRQRLSNKRYRGWGQLSTKLLTKIVDQNGQRIIDILWNTNDNFMRIIHSDDFDQAVTQANQMLLADNDTQDVINELYTSPSNKKALRQILLVVADIQKAMKGQAPARILIEFAREKQANPRLSTQRRRQVEQVYQELNNDQLNKELADPQYANLSKDRLFLYFMQGGRDMYTGESLNIDRLSEYDIDHILPQAFIKDNSLDNRVLVSAKMNRSKSDHVPLDFTEERFGQKMRSQWEQMLRAGLLTRRKYNNLTLNPDSLNKYTMSGFINRQLVETRQVIKLATNLLVDQYADEDVQLVTVKSGLTHQMREDFDFPKNRNLNNYHHAFDAYLTAFVGLYLLKKYPKLAHYFVYGQYQQGFKANDQWRNFNFLNGLRQEQQVDAETGELIWQKDHDLAYMNKIYDFKKILVTREVHTNHGALYNQTLYKAKDDKASGQGGRQLIAAKENRPTAIYGGYSGKTVAYMCLVRITEKKGDFYRICGVQTAWVDELEHIEDATIKLQRLTALLTPQFSATKKQKDEVVTVVKPFEVLLPKILINQRFYDGGQELTLASATYKNNAQELVLDKKAVQVLNGQLPKAELEAQATVVYDQILERVQKYFPLYDMNSFREKLFVGRDKFNELPWQDQWENHKLIQVGQKTILDRILIGLHANAAMGDLKALNMSTPFGKLQKSNGISLSPETQIIYQSPTGLFERRVALKDL

SEQ ID NO: 902 - protein, 1363 aa, Lactobacillus diolivorans
MRGNYHIGLDIGTSSIGWAVIDDNAKVMRAKGKTAIGARLYNEGQTAADRRLFRTTRRRLNRRKWRLKLLDEIFDPYITPVDAAFFARLKQSNLSPKDQNRDWTGSMLFPDRTDRKFHKDYPTIYHLRHKLMTEDHQFDIREIYLAIHHIVKYRGNFLNTTPVSSFSVSDVKFDEQFDRLNELYAAVSPDEPFAINGDNSKAIETLLLSDETKKFDKQKQSAKLILSETGDKALDKENTKVATQISKAILGYKTQLDVLLKYDAINSSAWKIELDDENIDDTLPGLLSQLDENRQEMVSIIQNLYAQVTLNQIVPNGMSLSESMIEKYNAHRDHLKLLKQLEDKIDDPKKKKGLEAAYDAYVGKNMKVANQDVFYASVKKNLDDSDLAKQIADLIEAQKFMPKQRTSQNGVIPHQLHQLELDQIIENQSKYYPWLTAANPNPKRIHQAKYKLDELVAFRIPYYVGPLVTPEEQEKSANQVFAWMKRKQPGTITPWNFDQKVDRMASANRFIRRMTTKDTYLIGEDVLPDASLIYERFKVLNELNLVKANYHRLAPAQKQAAYRDLFENQKSISTKKLQNYLVDQGYFTAKPKITGLSDPERFNSSLGTYIDFKEIFGDQVDNPDRQDDYEKIIEWSTVFEDRQIYEAKLRTLDWLTEDQIQALKTKRYNGWGRLSKKLLTGIVDENGERIIDVLWNTNQNFMQVQSQESFAKRIHEANAKQMKVTGVEDILADAYTSPQNKKAIRQVIRVVDDIQKAMGGVAPTSVSIEFTRSEDQNPRRTQSRESQLQNTFKVDAKEIVDSDLVTELETVSKSKKGLTDRLYLYFTQLGKDMYTGDPLNIDELSTYDIDHILPQAFIKDDSLDNRVLVSKAVNNGKSNNVPVKLFGGKMGGFWKELADHRLISKRKLKHLLTDPDTIDKYTMRGFIRRQLVETSQVIKLVAQILGDKYQNDDTKIIEVTAKMNHQMRENFKLIKNREVNDYHHAVDAYLTAFVGQYLYKRYPKLRPYFVYGNFKKFNEDHVSFRYFNFLHELMDENNKRIVEPETGEVVLEREPAIAYMKRVYHFKFMLISQEVYTRRDAMFNQTIYPAKEANRRKLIAIKHGKPVDVYGGYSGSVDAYMAIVRIHDKKGDKYKVVGVPMRALEILNATHDKKDYDAKLKQILVPKFTKVKKSRKTGEITKKVEDFEIVLGKVMYRQLVIDGDKKFMVGSSTYLYNARQLVLSDSSLDTLASKGTLDSDADSKRLVAVYDEIVEKVDKYFPLYDKNAFRSGLHKGRDKYLLLPNRSTFNGAKKVHSGKREILNEILNGLHANATLGGLKDLKISTPFGKMQGQSGIPLSSNTIICYQSPTGLFEHRVSLKDL

SEQ ID NO: 903 - protein, 1357 aa, Lactobacillus mindensis
MNDRNKKYNIGLDIGTGSVGWAVTDNNYNLLHAKKKNLWGIRLFDGAETAASRRTFRSTRRRYRRRRNRINWLNEIFADELAKKDQSFLVRMNSSWVSKKDKIRQRDQYNLFMDSDYTDVEYHREFPTIFHLRKRLIEDKSQADIRLVYLALHNIIKYRGNFTYEHQNFDVSHMDSGLALLLNQLNQQLQAFEVAFPDETNFESMSTILLEKKTPTQKIDEIVDQIQPEKDLLQITKNIMKMLLGNKADLVKIFSLDSDDKITVEFSSNSIEQDLSNLEETLSDEQFNIITLANSIYSSIVLNDILSGETYLSFAKARQYSDHKKDLAKLKTMWRESPDRKAVGKAKKAYDDYLHSGKYGIEDFYKDMSKFLETATPVELAKEANEKILNKSYLLKQRNNENGVIPFQLNKNEMIEIINNQAKYYPFLAENKDKLLSILSFRIPYYVGPLQSKKDNPFAWMEKKSQGKIRPWNFDEIVDREASSNNFIRRMTSTDTYLIGEPVLPLKSPIYQKYEVLNELSNVRINADEVDNPLGDKLSVDLKQAIYNELFLKHRSVSKALLTKWLINQSYFQNPQISGLADSKKFNSGLTTYHDFKKIFGEDFVNDPTNQSQLEQLAEWLTIFEDKKILKIKLDDSQFNCTPEQIKKIAGMRYQGWGRLSKKLLCDIKTTTVTSKNHQQASYSILDLMWNTNRNFISVLKNDTYKFEDKIQTFNLDKNEAATPQAMIDELQTSPALKRGIRQSVTIIQELVKFMGHAPEHIFLEFTREDDVSSLTKSRDSRLNKLYARIAKNTKKTDDELKKSLLPSSDIKATLKANKNNLSNDRLMLYYLQMGKSLYSNQPLDINRLSEYQIDHILPQSYIKDNSLENRALVLASENQHKSSDLLLKPEIINQNIARWRYMKDAGLMGPKKFKNLTRIQITDSDQNNFINRQLVQTSQIIKHVSNILDSMYGDQGTQCVETRAHLSTEFRKAFSNEDDNYHFQHPEFVKNRNINDYHHAQDAYLACLLGLYQMKKYPTDNMILLKKEYKRFFSNTKKIYDKKHHFPDYVKNGWIIGSMFNGEKYVDEETGQIIWDQQTKDMVSCIFQYKQYNVTKRTEAANGEFYNQTVYKKDPNEKRKLISLKQGLDTKLYGGYSGDNPAYIVLVKIDDKKNKLVKMPIRLAEQVDNKTIDLQTWLEENVPHKKGIQVLKTKIPLGQVIYSKKNGYLALKSDTEIVNAQQLVLPYGYVALLTLLQKMPENKYDEVLACYDDGILDNIFVAIIDKMKHFYPYYSGELKTLSDNIDNFKESPDVNKIKTLQQLLLLLHASSTTASIEFNNVKKNSLGRKPNSINIQNTDLLSFSATGLYESRIHID

SEQ ID NO: 904 - protein, 1347 aa, Lactobacillus versmoldensis
MTKREEPYNVGLDIGSSSVGWAVVDNNYHLLNIKKNNLWGARLFKEAETAQVTRGHRSMRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 905 - protein, 1390 aa, Lactobacillus psittaci
MKEVKDYIIGLDIGTNSCGYVVTDKQNNILKLKGKTAIGARLFKEGEAAADRRAFRTTRRRLARRRWRLGLLEEIFDEEMAKVDSSFFRRLKESDYSPKDSRKQFNSIVFESSEADKDFYDKYPTIYHLRNALMHDDQKHDLREIFLAVHHIVKYRGNFLREDSVKAFKAAKFTLQGEDGIGPVDKLNDLLKEIYIEAAPELATDNLSKIEEIIKDKKLYKQDKLKQVATLLTKEADTKDKAKLNKDVAKQVANAFMGYMIIFDTIFNLSDVDSKDYKVKFSDANIDEKLDTLTSLLTDKQTEFVLELQNIYNTIVLNEIVPDGKSLSESMVKKYDDHKEDLKLFKAYLNSLTDVKKVKELKAAYVLYVNNRKANLLAAKKLLGKKADNMNNFEIFSKFVADNLDDSELANKIRARLDLGEFLPKQRTNQNGVIPYQLHQVELTQILEKQGKYYPFLIAPNPVESHRNNAPYRISELVSFRVPYYVGPLIDPNNAESEQDKANSSFAWMVRQKQGQITPWNFEEMVDTTESANKFIKRMTTKDTYLLGEDVLPASSLIYQKFVILNELNNIKVNGIKLTSEEKHQIFDELFKVQKSVSLKNLVNFLTAHGCVAPNVTGLSDGTKFNSSYSTYIDYRKIFGAEIDNKDKQADFEKMIEWSTVFEDRKIFKRKLEEITWLTPDQIKQVSSKRYSGWGRLSKKLLTQITDENGVNILQRLWNESENLMQILSDPVIKEKIVAANSSFTKATDMEDILAEAYTSPQNKKAIRQVMRVVDDIIAAAHGKKPSQIAIEFAREDQDNPQMTKSRKAQLDQIYAKISDEFLDNAVKNELKNMKDNKPLAKDKVFLYFKQMGRDAYTGEKLSLDNLQDYDIDHIYPQSFIKDDSFDNRVLVQRAVNNGKSDNVPVLLFGNKQAADLGMTIRQMWKKWLELGLISKRKFNNLITDPEKISSYMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAESKEDDPVKKIKQFNFIYQLLWGKDDAICISHTDQQVFSRSDIINKLTTAYNFKYMNVSQEVYTNSNNVFKQTVFPIIERDTAKSRSLIPKKLDRPTDIYGGYSNNNDAYLALVKVDKKKGSEYRVVGIPMRAAAMLKASKNYDEDLRKVIEPMVMLDKNGKAKRGIEGFRVLVGKMPFKQAVLDGDKKFMLTGTNDMPNLKQLVLSQQNMKYILDYIDDIDCRKHKFGNKTQDGNKCLLEVFDEIIQIVDKHFELFDNRSFREKLRNSRVNFINLALSKKAEALLAILNGLHANSMRTTIKELKISDLGRIQSSVISPEAQLIYQSPTGLFERRVKVKDL

SEQ ID NO: 906 - protein, 1368 aa, Lactobacillus paracollinoides
MDKKYSIGLDIGTSSIGFVGVDENGWPLNIKGKRAIGAHLFREGEAAAETRGFRTTRRRYNRRKWRLRLLREIFDEPISRVDPTFFARMKESSVSPKDPNYDGLAKEILIPRDKDGKILYPTIYHLRHALMYEDHQFDIREIYLAIHHIVKYRGHFLLDGAAKNFESSNLDLKSDIHEINAILVGIFGNEQVQFNDQYVEKLKEVLLDSTQSRSDRQKAAAKLLLPTNDLDKDTTKILKTVSTEITKAITGLKAKFFVITGNDIAKDQQKDWTFSIDTLDEKMSVIEPSFSEKNFSLITILQKLYSSVTLAGIVPNGLSLSEAMIQKYDRHASDLVLLKKYWDTKPKVLKHQLQNTYAEYIEIHQVVDEFYSDLSKLIKNDDDTLAQEIKSKITIGNFLPKQRTTENGVIPYQLQQRELDTIIKNQQEYYPWLAEENPVADHQIAFPYKLDELVGFRIPYYVGPMIAKEDTSNSKNSKFAWMIRKQSGEVTPWNFDEKIDRTASATAFIDRMTTTDTYLIGEDVLPKQSLIYQRFEVLNELNKISIDGQPITRKQKQSVYTHVFEKKKTVQVKDVQKFLVSSGEVMSLPKIGGLANEKQFNSSLSTLYDYNKIIPDALEDRNKVDDIEKIILWSTIFEDNSIFVEKLDSIDWLTSSQRKRLAQKRYRGWGRLSLRLLTTFKNKDGYSILDELWNSNHNFMEIQAQSDFSEQIATANNNNLSQVLPAKWEPGRKNLASLDEFISNLYTSPQNKKALRKAIRVVQDMMTAAGHMPEKIFIEVARDTSNSHQQTIARQRQLQQLYQSEDKEVIDSSVRSELDDILKNRANIKDQLFLYFQQGGRDLYTGKAINIDKLSLYHIDHILPQSLVKDDSLDNRVLVSQKTNEDKGVTFVSDKYMNNMLPTWKRWHEMGLISARKLKNLTMRPDEIDKYAPGFIQRQLVETRQVTKLVIELLDALLGNSQTEIITIKASLSHQFRQQFDLVKIREVNDNHHAFDAFLAARIGTYLYKRYPKLRPYFVYGQYMQNHKNLKSINLIKTLDSDKAIVDEGTGEILWDKKSDLAKMIKIYNYQRLLITHESRTSFGAMYKQKILKATDAKQNGGGFKLVPTKRNRPVDIYGGYTGQTAAYLTIVRVYSKKTSELRVLPIYTNKVQQIEKAMTQGDKATMLAFKKVIAPQLGKENKKTHEIKIPEFDVVIPKVLLDQLVIDDIAGSPHRFRLGTDTYYHNSQQLFLPLSMQRQLMDRESDDKVYLDIFNDVLKQVDSYFNLYDVNGFRAALQKSKKAFEQLPINDFPKDVPDNKKKKGKRSILKEIFIGLHANATLGNLKQMGIKTDFGKLQKSNGLRITENCKIIHQSPTGLFERIVPIK

SEQ ID NO: 907 - protein, 1357 aa, Lactobacillus oligofermentans
MAAKNYNIGLDIGTSSIGWAIVDDNYQLMHAKGKYGYGTRIYSEGQTAADRRGFRTTRRRLNRRKWRLRLLQDFFEPYILPQDEAFFIRQKQSNLVPQDTKKQYPESVLFDDTSDKDFYTEYPTIYHLRQALMTENRQFDIREVYLAIHHIVKYRGHFLNNAPVKTFKSGNLDLAIKFNELNEEFKSVYPDLELQFNLDQIDEIKKILLDSTKSRFDRQGEAVKLIYTVSEVKTIEKLQNKIVKQFLSGILGLNTRFDVLTNTESDDSMWKFSLDSESSDDALDEIIAQLDDPAIHVVELVNEIHSSITLAGIVPEGQGLSESMVEKYEAHKAHLQLLKAVEKLVDKKAADKLEVAYDQYINGKDSKQFIKEDFYKAVQSEIKGVAGDEVAEINQLIELDQFMPKQRTKENGAIPHQLHQHELDVIIENQSKYYDWLGEKVGNEYKLDKLVSFRVPYYVGPLVDTASKEKKDETRFAWMVRKNPESTEAITPWNFEDIVDKNASAENFIKRMTTKDKYLLNEDVLPKCSLLTQDFEVYNELNNIRVNGEKFTAEQKQLIHDELFTKHASVSIKQLKDFLVSELMYVRDNLKVEGLADEKKLMSSLSTQFDYQKIIPDQINDVKYREDIEQIIEWSTIFEDAAIFKTKLKEIDWLTDEQRNKLANKRYRGWGSLSKRLLACLVDENGQRIIDILRDSSDNFMMIVNRPEFKQAIFDENANLTETNSKKDMFEMIDNFYTSPQNKKAIRQVLLVVQDIQNAMGGVAPQKIFIEFAREDEVNGRRTNSRYSQIREMYSKVTDDVINKTVRGELEANKGSLNKEKLFLYFLQGGIDLYSGKTINIDNISSYDVDHVLPQSFIKDDSINNKVLVNAKGNRVKNDNVPMELFGAKMYPTWKRMVDTGIMSKAKFKNLTLNPDNVDKFKAEGFINRQLVETRQIIKLVAQILNDKLGDDTKIVSVKANLTHDMRVFFDFPKNRNVNNYHHAFDAYLSAFVGTYLYKRYPKLQPYFVYGEFKKMDKLKNMTSFDFLRDLKHTDKVVDKDTGEIIADKLAVITNMNKIYDFKKVLVTHEVHENSGAMYDQTLYPAKLDKSLGRKGAKQLIPKKDDMPTALYGGYTGSKDAFMSIVRLKKKDEVYYKVIGIPVRIADSVQHGKEVDVEALTQFIETKFTKENLNKKTGEITRKVEWFELVLPKVLFGQAVFDGGQPFMLGSSTYPHNLRELVLTKDSVKKIAGKESNKSYLDAYDEIMEAMNKYFPLYDTNKFREKVIEGRSKFIDLPDKDEYENNKLVQVGKSTIIDRMFIGLHANAARTDLKNIGITTPFGFMQQASGIKLTKDTVVLFQSSTGLFERKVALKDL

SEQ ID NO: 908 - protein, 1369 aa, Lactobacillus rossiae
MDKSKPYGIGLDIGTNSVGFVATDAEGHLIRLKGKTVIGAYLFNAGISAAERRGFRTTRRRLSRVKWRLGLLREIFETHFQESMGENEDNDFFLRFKYSNISPKDPQFSTAKGLFNDRTDKEFYDQYPTIYHLRRALMTEDHQFDIREIYIAMHHIVKYRGHFLKEGRAKDFKVGDLRLLDNFKMMNEQIEEINPLWQLKLPTDDASIKSITAILLDNTQSQNDRQKAVTKVILATLVKASDKDINAARKRFVGELSKAMVGLKTKLWVLADVSQNGDWEIKYENYADFAETIGSGESDTIQSLFNEINDLYGVITLAGIIPKEAESFSDGMVRKYEHHRKNLELLKVYCAEQSDGKRGRQIRQTYDKYIDGVDSKQFTQEDFYKALSKFTAKDEATSENAKLIAQEIAVGTFMPKLRTKANGTIPHQLHQKELDAIIENQKKYYPWLGEVNPVESHRRALPYKLDELVSFRIPYYVGPMVTPTKGDPEKSKFAWMVRKEPGTITPWNFDQKVDRSASGEAFIQRMKTTDTFLIGEDVLPQQSLLYQKFEVLNELNKIMINGKPICREQKQRLFKQLFMQYKTVTVKKVQQNLIANGEESENVPITGLSDPLRFNSSFSTYIDYKDILGTAAVNDNAKQSDIEQIIAWSTIFEDAAIFREKLNDITWLNDDQRNKLSHKRYRGWGRHSRKLLAGLRDGEGQTIIERLWNTNDNFMQIQNDSEIARQITEANSSKMATAEGTDEIIDGFYTSPENKKALREVMKVVKDIQRAHHGQAPAWVYIESPRETPRPGQRTVSREQQLTDLYEGAAKEIVDDAVLNELKDKVKSKENFTDKLVLYFLQNGHDIYANDSINIDNLNAYDIDHVLPQSLIKDDSLDNRVLTTHERNLKKSNRFATELFADQRKKWEKWHRLGLISSRKLKHLTMQPNSVEKFAHGFIARQLTETRQIIHLTANVLSNLYQENDTKIVMIKAGLNSEFRRTFDFPKNRSVNDYHHAFDAFLTAKIGRYLLARYPKLEPFFVYGNFVKNPKAMKRLSSFDFIAQLAAKTDDTSHIDQRSLKQVPVVNEETGEIVWDKDIELAELDKTYNYKTMLVKRAQTENNAQMFKQTVFKARDNQNKTLIPVKNGLSTDVYGGHSQQAISYLCIVWVGQKKKYRVLGISTAHAGILNNFEKNYGRFEAKKKLQEIVSNTLDNADRNDFKIVAPKVLFEQVVEDDNMKFGLGSASDYRNVQQLFLSRKNQLLLANMMTDQIHDQDLVHLFDEIVGQMNAHFPIFDRGGYRSSLTQSRDKFLKLPFKKNEDLITKQEVIRRILDGLHANANRKDLKIIGSKGDFGRLGTKKIYLSKDAKLIYTSPTCLFTRTVPLSSL

SEQ ID NO: 909 - protein, 1369 aa, Lactobacillus sakei
MAKTYNIGLDIGTNSIGWAVVDDQNHLMSIKGKYGYGVRLYDEGKTAEERRSFRTTRRRLKRRKWRLSLLREIFEPQITPLDNTFFLRQKQSSLSSKDNRKLYPEMSLFNDRTDTDFYTQYPTIYHLSRDLMTKNKQFDIREIYLAMYHIVKYRGHFLNESPVSSFKSSEIKLAENFETLNQIFNERFNESMFQLAVNDFDDLKALLLNDQQSASNRQKKALGMIYVPNENKSLEKQNKAIATELLKAILGLKAKFNVLTGIEVDDAKPWTLSFNSESFDEDIDKAATNIDDDSREIIAILQGLYSGILLAGIIPENQSLSEAMVEKYDQHAAHLKQLKSIYPLLSISDKKAIQQAYNYYIDGQDNAKAYSREDFYAATTKALKSYQDNETIAEILKLIELEQFMPKQRTKDNGAIPHQLHQQELERIIENQQKYYPWLAELNPNESRRKIAKYKLDELVAFRVPYYVGPLITSEQQQQSSNKKFAWMIRKAEGKITPWNFDEKVDRQASANEFIKRMTTTDTYLLAEDVLPKQSLVYQRFEVLNELNGIKIDDVPITVEQKQRIFNDLFMMQASVSVKNIQDYLVSKGYFASRPEITGLSDENKVISRLSTYHDLKAILGGIVDEANKQADLEKCVEWSTIFEDGKIFVEKLNEIEWLTDEQRKRLSSKRYRGWGRLSNKLLNQIVNENGQRIMDLLWDTTDNFMRIVHSEEFDKLISAANQTLLSKNDVQDVINDLYTSPQNKKALRQILLVVSDIQKAMKNQAPSKILIEFAREDEANPRLSVQRKRQVEQVYQNISKDILSDSDVKAELKDLTNTALANTRLFLYFMQGGHDMYTGETLNIDRLSEYDIDHILPQAFIKDNSLDNRVLVSAKMNRSKSDQVPLNDYTEERFGSKMRVQWEQMLRAGLITKRKYDNLTLNPDRISKYAMKGFINRQLVETRQVIKLVTNLLMDHYEDDEVQLITVKSGLIHQMREMFDFPKNRNLNNHHHAFDAYLTAFVGIYLLKRYPKLTPFFVYGSYQKNNTNDKWRNFNFLNDLKKEEVIDSDSHEVIWNKAQGLVELDKIYQFKKILVTREVHENTGALYNQTLYSAKDDKASGQGGKQLIPAKQDRPTALYGGYSGKTVAYMCIVRIKSKKEDTYKVCGVKTSWVAELERLSDSNEQLASLKAKLMPKFTKNKKQKGKTIQVTEDFEIIVPRVLINQRFYDNGQEITLGSATYKHNEQELMLNKKAVKLLNGQLSLVEAETLAPQVYDEILKQVMKYFPLYDTNQFRTKLKMGKEQFIKLPWKNKWDGNKLIHVGQQTVLDRILIGLHANAAVSDLSTLKVTTPFGKLQQPSGIALSLNTKIIYQSPTGLFERRVALRGL

SEQ ID NO: 910 - protein, 1352 aa, Lactobacillus gastricus
MGKRYHIGLDIGTSSIGWAVMDDDFKIMRVKGKKGIGVRLFEEGKTAAERRGHRTTRRRYSRRKWRLNLLEEIFDPEIAKVDPTFFARLKESNLSPKDDRKQYSGNLIFPEKAKEEIREWTEKYPTIYHLRNALMTENRQFDIREVFLALHHIVKYRGNFLFNGNFQTGEVNLSDRFDDINSAFISACGEEEAPQIPSELYNDIQELLFDKNTRKLDNQKQLATKLSQDNDKDWSTQFSKALFGYKTKFKVVLQSNEDLDDFQLDSDDADDKIASISEQIDDDRGSILDNIKILYSRITLNEIVPDGKTLSQSMIEKYNLHRDHLKEIKDQLKHTDNWVKFDDLYSQYVNGKLESDRHKKLSSDDFYKKVLTLFDGELKTRVKEWQEKGEFLPKQRTGSNGVIPHQLHQNELDQIIENQSKYYPWLATLNPNEKRQRVAKYKLSELVAFRIPYYVGPMVTKDQSDFAWMVRKSDEKEITPWNFDQVVDRDKSAEEFINRMTTKDTYLIGEDVLPAKSLLYEKFTVLNELNNIRINGKPLTTDEKHQVYRDLFQNAKSISTKKFHNYLVCKLNKPNHLNITGFSDLTKFNSSLDSYIDLKKIFADQIDDQSLQDDFEKMIRWSTVFEDKQIFERKLSEINWLTDQERSEVAKLRYRGWGRLSKRLLAGIHDENGQRIIDALWNSPKNFMQIQAEVAFNKQINDLNTKELSDNNVEDVLADAYTSPQNKKAIRQVLLVVEDIQKAMHGDAPTSISLEFAREEQESSRTRSRRAALSATYRQISDEIVSATVKGELGKATSISDRLYLYFTQGGRDMYTGEPINIDEISRGYEIDHILPQSFIKDDSLDNRVLVKGAINNGKSANYVMDQSWAPDRLAWWKKLLDNRLISRKKYQSLTLTPGKINKYSQNGFINRQLVETRQVIKLVANILNDQYSNDDTKIIVVKAALNSQLRGFLELFKNRNINDYHHGMDAYLSTFIGNYLYKKYPKLRSYFVYGEFKKFSGKQNLKSFNFLHDLEDDSINIISNDDGEIVGNHHEMIEELEKAYQYKYMLVSREVFEKTGDLFNVTVYSRKAKKTLIPIKQDKPINIYGGYSGNNDAYMAIVKLPGKKGKPDTYKIVGIPLRFAGELERAKQLGESAYREKLSAVITPQFTKEKKDRKTGEITKVVDDFEVVLDRVPYRQLFKDSDKWFMLGSAAYQYNAKQLVLNNDDVKLLNEQGRKKLELPNEKLSSALNDVFDHIIQIMNSKFGLYDKNGFRTKLTEAASIFYDLPLRAEYNGNKKVTDGKLEVLDNILIGLHADPSFGNLKQLNMSTPFGQMQTKGGVVLNGNSTLIYQSPTGLFERRVKLKDLSK

SEQ ID NO: 911 - protein, 1131 aa, Lactobacillus saerimneri
MNSKINVPVSIGFDIGISSVGLAVIDAKNGSVLEAVSDIFSEGSSEDNKDRRSARHSRRSSGRKNTRLRDSQRLLQNIGFIKGDNVKLAFREIAYANQKVYELRVKGLTECLTKDEISAVIQHMIKRRGVSYDLKDYEDEEESKKTSNYKASVAINQQLLKTYTPGQIQLDRLHKFGKVRGMVESDGNVTLRNIFTTTAYALELEKILRTQQKYHPELTDDIIDKFLKILKRKRDYTKGPGSKKSLTNYGIYKTDGRVLDNLYEELIGKDKYFPTEQRAASNTYTAQYFNMLNDLNNLRILNSEDGKLTFNQKKNIVDEILNSDAARLDAFKVIMKVTKANKNEITGYRIDAKSRPLLHSMKIYRRVKREMASLGISTDQWSDKVNINGEERIFWDDLAYIISLNDESGELRRRIIRELKYNYEFVDNKLVDAIVDNKKLFAVDSGNKWHNFSLKTMKLLIPELENTSKEQMTILTDLHLTKKDKIDYRLKNKIDVDHILKDIYDPVVKRSVRHAIKMFNVIVKKYTNIEYVVIELPRDRNSTEKKKSIQKFQKDSFNEKDLAMKAFADKLGKSTKELDVFFHKNRKLATKVRLWYQQEGRCLYSGETIPAIELLNNSEAYEIDHIIPISVSFDDSLNNKTLCLGEMNQRKGNRIPWAMFNDGFGQGYTQMCHMLKNNKRLSKQKKHNLETRIDINDLETRKRFIARNLVDTRWASRVVFNELQDFVKAKGLATKVSVVRGKFTARLRREWQIYKTRDTYYHHAKDAAIIAVTPYLDIWKKNNYKMVPKQVGEGMVDIDTGEIISENKFNSYMYREPFTGFVKNVRRMDRVIKIKHTADMKMNRKLSDATIYSVRDVKLSSDRKNEPYRLGKLNIYNLKDYKTLKKLITKTPDKILMYHHDPKTFAILQEIMDIYPDKIDKKDVSPFELYRRENGKVRKYAKKNNGPEITEIKYYDKKVNSCIDITPEDAKNKRSVLLSLKPWRSDVYFNHTKNNYEVIGLKYNDISEVNDLKGIKREHYNQLLRKQVGNDKVEFCFSLYRNSIIKVINDREDIELRFGSSKTQRNKVILKPIDRALFNSYEAVKIYRKASNAGIIERSFSKPGYVILKANIDELGNRHYLRKEEGPKDIL

SEQ ID NO: 912 - protein, 1362 aa, Lactobacillus hammesii
MNQEPYAIGLDIGTSSLGWANADMDGYIARVKGQTGLGVRLFEEGQPAADRRSFRTTRRRLSRRRWRLRLLREIFDEPISSIDPNFFARQKASSISPKDDRFETTYQLFNDKTDQEFYSKYPTIYHLRWALMTEHRKFDLREIYLAVHHIVKYRGNFLRSGNPKSFKPSELDFSQRFKEVNGLWHLIFDEVAPQLPTDNLEEITKLVLDTTRTRADRQRESVKLLMAATDNHKDWKPYLTEFTKAILGLKTKLYLLTGVDVAKADQKTWTFSLEDIEDHRADLETAFDDRSLELIEKLVDLQAAIQLTEIMPSGQYFSQSMIYRYDQHKEHLRWLKDYAEQQTDANKRKAVRLAYDHYIEGDAKGKPEIADDFYKELNRILKGDTSELAKKINHEIALEHFMPKQRTKENGVIPYQIHQQELDSIIDNQKKYYQFLGEDNPVVSHHGSQPYKIDELVSFRVPYYVGPMITADQQKKTAAGQFAWMVRKDSGDITPWNFDDKVDRTASATNFIQRMKTTDTYLIGEDVLPLQSLTYQKFMVLNELNNIRINGELLTREQKQRTYNDVFKGHGTVNVKSLIKSLECHSEVTGAIKVEGLADPKRFNSALTTYRDFKKILPVAIDQPQRQADIERIINWSTIFEDADIFKAKLQEIDWLTDTQRDRLSTKRYRGWGRLSAKLLLNIKDTQGLSIMDQLWNTQHNFMQIVHEPDYAEKIEKTNAKGLKQQDIFETINEMYTSPQNKKALRQILAVVRDIQKAHHGQAPSRIFIEAARGAEQNPQRTRQRQKQLADLFADQAKEIVNETVAQELNDETDNKARFTDRLMLYFLQNGQDMYTGEKLNIDKLSTYDIDHILPQSLVKDDSLDNRVLVSKVENLKKNDHFASELYARKMQGTWELWRSAGLISARKLKHLLMRPDEINKYATGFIRRQLVETRQVIKLVTDVLSNEYDSDKTKIISVKAGLSHQLRMELDLPKVRELNDYHHAFDAFLAVRIGTYLLKRYPKLERFFVYGQYQVAPQLDLRRFNFIHDLVSGKQEKIVAEETGEIVWNREKDVSYMKHLLSLKHLLVTHEVKEDHGALFNQTIYKAKKDNGNVGGKMKLLPTKSNRPTEIYGGHSSQAIAYLAIVRVNGKEPSYRVMGVPIRILDQLKQAKKQGEYAERLALKQFFTPDFTKGKGKIVSDFDVVIPHIPLLQPVIDEISGQSHRFALGTNTYYRNLQQLILTLADQKVLISKETGVDEEKKLVEVYSHICQQVMKFFPLYDRNKFRELLVDSRSHFEQLPIVNRYSDAGKLEIAGKRGILQQIMVGLHANATPGDLKELGVKTPFGKLQVPGGIKLTENAKLIYESPTGLFKREVKITTE

SEQ ID NO: 913 - protein, 1316 aa, Lactobacillus apodemi
MLQKNYTIGLDIGTNSVGYAVINDNYKVPAKKMKVLGNTDKKTIKKNLMGVLLFDAGETAATTRLKRGTRRRYTRRRNRLRYLQEILGPELAKVDANFLHRLAESSLVTEDKEFSAYPIFGDREEELLYHKTYKTIYHLRSALANKDEKADLRLIYLALAHIIKYRGNFLIEGEIELSDTDIDKVYADFCRSFNELFDTEVLQEIEVEAIFKDKTLSKTKKAEELVKVSGVKKNQVAHQFLKMMVGNTVNFKKVFNLTEDQKLSFGTDSYEDELNDLLAKSDDRYLDVFVAAKKVYDTAILANILNTKNSVATKTIFSQSMIERFKDHQKDLKELKQLFKTYLPEKYPDFFGNSKEDGYAGYIEGKTNEEKFYTHTKKILKNIPQAASVLAQIDVGNYLRKQRTFDNGVIPHQIQLKELLAIIENQGKYYPFLLENKEKIAKILTFRIPYYVGPLARGNSRFAWLKRVGKEKITPFNFENVVDLESSAERFIERMTLNDLYLPEEKVLPKHSMLYEKFSIFNELAGIRYITDNGEMKFLDAQTKQSIFELFKQERTVKEKKVLDLLKTLMPSERVVAIKGIDNGKFNASFGTYHDLSKMGFKTEKIASESNQARWEEIIKTLTIFEDRKLIKSRLRKYDDFLNEKEIGALSKRKYTGWGRLSAKLIDGIYDKKTHQTILDFLMNEDYNQNFMQLISNDNYSFKKIIEDSQVIKEEGSLTEVIQELPGSPAIKKGILQSIEIVDELVKVMGGNPKKIVVEMARETQKTHGTTRREARIKEIIKNLNKLKLNELPKDLPSNEELSDEKVYLYCLQNGRDMYTGAPLDLDNLSQYEVDHIIPQSFLKDDSIENKVLTAKIENSRKTNGLPSVEIAKKMGAFWRSLLKVGAISEKKYRNLRRSLHGGMTEKLKETFVKRQLVETRQITKYVAQILNSRFNEEKNEDKVAIVTLKAQLTSQFRKDFELYKVREINNLHHAHDAYLNAVLATLLMTSFPELEPEFVYGKYRKTKFKGLGKATAKNNLYTNILQLLKEESAQYWDTKERDLATIKKNVYQAQVNKVRKVERQTGSFYDETVAKKSASQKLFPRKNGLDPVKYGGYQRANEGYSLLFRADMLNKRGKTKSVKTLVKIPIIESAQYLADPTEYLAKRGYYNVSEHSLLLPKFSLLENNNGLRRYLASSNEFQKANELILPKHLVRLLYWSQSKQRKEELNKHRAEFAELFTYIMDFADKYVVAPKNSEKIKNIYENNKDSSVEVLGKNFIELLKYTADGAASDFTFFDTKIPRKRYNSAGDLLDGTLIYQSKTGLYETRIDLGAI

SEQ ID NO: 914 - protein, 1366 aa, Lactobacillus concavus
MDKKYNIGLDIGTSSIGFVATDEDNHVIRAKGKNVIGVRLFDEGQSAAERRGFRTTRRRLNRRKWRLNLLREIFEPHIYPIDASFFMRQKYSNLSKQDPNQKIEFKDILFSDKSDAEFYRQYPTIYHLRQALMTEKRQFDLREIYLAIHHIVKYRGHFLDETPTDKFSFDQLDLTQEFERLNVLFSEQNPEEPFEIVVNQNQSIEDILSNQSMTASDRRKQALVVFYQQSENKENEKQYKAIATEILNLLLGNKAKLNVILAQEVDKEAAKDWSLSLSSETFDDDLEKASSGLNDSQLEMVGIFERIYSSLILKSIIGDHNSLSAAMVDKFKTHAQHRDLLKDVIKNSDATKGEQLQFAYDHYLQRHSADGKAYGKDDFYKEVKKNLDDSDAAQQIQQLIDTDQFMPKQRTKANGAIPHQVQQKELDLIIENQCQYYPWLAEENPNSERHNVAKYKLDELVSFRVPYYVGPLISPADDETDPQAIQNTKFAWMIRKDAQGRITPWNFDDKVDREKSADKFIKRMTTTDTYLIGEDVLPDQSLIYQRYKVLNELNNVRINGRPIEVQIKQNIYTDLFKKFKSVSVKKLRSYLEEMSYYPGSFKISGLTNPGKFDNGLTSYLDYKNILGDSVDANDKRADIEQMIEWSTIFEDNKIFAQKLESMTWLTAEQRKAISRKRYTGWGRLSNKLLTQLKNQDNRSIMDLLWETEENFMKIQSAPDFSKMIEAHNQQFIKNEANIQQVISDLYTSPQNKKAIRQILLVVDDIQKAVGHAPEHIAIEFAKGEDKNPRRTISREMKIQDVYQQISDDILVSPEVRAQLNEKIENRHGRLSDRLFLYFMQGGRDMYTGKPININNISHYDIDHILPQAFIKDDSLDNRVLVSDKLNREKSDTVPRDLFGREMMSTWEKMADRGLITKRKLANLKTIPGSIDAHKAQGFINRQLVETRQVIKLAVGIMIDQYPETQIVSVKANLTHEMREMFDLVKNRDVNDYHHAFDAYLTAFVGNYLLQRYPKLEPYFVYDKFKKLKDQNISMRDFNLLYDLKKNEDVYDQRTGHSAHKIWDQHGSIDYIRHLFAYKKILVSHEVHQNGGALYNMTVYGKADDAKRKLIPIKADKPTELYGGYTSRKLAYMAIVKTKKGKKEQYQVTGVPVSALTTLRQFKEDSPEQKQALEEIVRRNFDEKTEVEIIVPKVLFNQLIVDEKCRFMVGSDTYRYNAQQLVLSADDLEIINASHKDIQTIDSSDYSQQLDQVYQNILTIVDKHFPMYDINKFRTKLHDIYEQYIELPNEDVWENNKLTTLGKHTIIIRILQGLHANATVVDLKQLGIKTPFGFMQQARGIVVSPDAQLIYQSPTGLYERRVRLGDL

SEQ ID NO: 915 - protein, 1366 aa, Lactobacillus composti
MTKDYSLGLDIGTGSVGFAALDTNYRLLRAKGNNVIGVRLFTPAETAEERRGFRTARRRLSRRRWRLGALNGIFAPELAKVDPNFLHRLKYAWVHPADQQNKGKYSAAPLFNDAALDRQFHDDYPTIYHLRLKLMTDTSQHDLREVYLAIHHIIKFRGNFLRGEGPINASEAFDINTFIDQMTAFYDQAFPDFKIVDQVDQQIIFKGLTDMTLSPADRANKALMGFNNAAQQPNKRIFKAILSGLVGNQVDLMAIFQLDGIPKEDQKEFKFKFVDNDIEEKLAALGDNPALSDEQNEFLTTLYAAFSGLTLKGLLGDATSISAAMVARYASHRTDWTYIKDHVLTPQNNRELRLAYADLMTDNEDVRLKAGKKFAKAIEAADIPAAKKSEFSLKIDNNEFLPRQRTKANGTIPHQLHLNELQQIIENQGQYYPFLKATFEQDGHTLNKIEGLVKFRVPYYVGPLVPKHKVAGNNANHWMVPKEPGAITPWNYTEKVDRDKSGNEFIRRMTGTDTYLLGEPTLPKNSLVYQEFNVLQELNNLRIEKRRLDIAVKQDIFEHVFKTNKTVTVKRIEEYLTTEFGSPVTLSGFANVNERKLNSSLSTYHYFVGIFGAEFVDDPKNLTLLEQIVELQTVFEDRKALQRQLKLRPELSEKQVKQLARTHYTGWGRLSQKLLTSKIVHVALEGEREPGQYSILETLYGTQMNFMEIVNDMKDRYGVKSWLDQENSGSENNLSLKQRILDMPGPKNIKRGINQAFHIIDEITRAVGNAPSRIYIEFARESQQSNLTNARVNRLKQLYSNQALKKEFAKLASEIKDLTKEQLKDDRLYLYYLQQGKDMYTETDIDITKISSNYQIDHIIPQAYTKNNSLDNRVLVNSEMNARKSDSPTFLPSLIQERKAWWRQLRDTGLMSTIKYNNLTRTSDDFSADQKERFIARSLVETRQVIKNVATLIKEYYDDSQVEALPSEITAEMRRYLNVRKNRDINDYHHAHDALLFATAGEFSRKVGIMEKGRVSDGAGNIYNRYTKDIIQRARAKAGQDKKVRPFTFIVGSMANPDTKFQTNQTTGEIVWTPEDVAYLRKVIDYKKMLVTKMTLDQTGTLYNETRYGSGDKHVAVALSKDKAADLYGGFGSLKPAYAALVYSKKKFRLVNVLRLWLPEIKKNASVLERKVQSVLGDDNAKVIRAHVPCGQLLIKDGALVTVSSATELHNFRQLWLPKADYQDISILLGAPDKVTAENRLQAESHFDDVDQRFESLLKDVIDQARQYYPLKTHQTSLEKLIGKIGKFDELKFAQKQQVFSRLLSALHANATNSDLKQIGLSTAWGRLIYPKGVSLTDEDKLINSSFTGLFNDVMSIKEFHDFSIN

SEQ ID NO: 916 - protein, 1064 aa, Veillonella sp. DORA_A_3_16_22
MRHILALDMGTASTGYAIIDENYNVLITGVRLFREGTAEENVGRRRFRSSRRGVRRSRHRLDRLKELLTNVIGVSGDQSYTNLYEIRARGLNNKLSPDELIAAIIQLAKHRGIFYLSPEDLAAEDGSGQSSADIIRTNEYKLKEGVYPCHVQLEKLNTTGIVRGIENKFTHESYRNELIKLLEVQSEFYPKLKGIINDILCIYDSKREYYEGPGSYKSPTPYGSYQLDESGNVIKINLIDKMRGKCTYFPDELRAPKWSYSACLFNLLNDLNNLTIQGMKITEAQKQELISEYVNKGKSVTIPAIAKVCGVKKEDIFGFRIDKKEKPIFTKFEGYNELLKIAKSVNEEATIEGNKQLVDDISEILTKEKSIEIRKKTLIDDLNLSVNLSKEIAKLGDFTKYHSLSFKAINLILDSLLKTSKNQMELYTEAGIKPYNHNFSQNNQLSANLSDWIVSPVVKRSINETIKVFNALRKYLKTQMGEDAEFSDVVVELAREKNSQEKKDLIKKIQKANEEKRYKIMELVENRRLTRAEFERISLLLEQDFKCAYSLEPIELADVFKAGLLEVDHIIPLSISLSDAQSNKVLVYQRENQAKGQRSPFQYFCSGKAKITFERYKEYVTKNLNFSNAKKSNLLYLGNPVEDMKGFIERNLVDTRYASRETYNLLKSFFEYHNINTKVKVINGSATSYFRKKAYLSKNREETYAHHAQDAMIIAGFANTKLMKFFSKIGAFSESLNHKDSIVEVDGNIINSETGEVLEQELFDKSENVSNYIQFLKRIESIEPLYSHKVDRKPNRALYDQQIKATRSFVEDNKEVTYIITKYSDIYNTEKGNSGAKLKKRILESPEDLLMYHHDPKTFEIFLKIVEQYGEEDNPFAAYKEDHGPIRKYSKKGNGPIIESVKFREKQLGSHRVNTKQNGHNKSVFLKIKSLRTDVYQDGENYLVLNVPYDMVSFVNGRYIIDQDKYMKAKQAQKIPESARFVTSLYRGDYIAYEENGELVECIFKCINNEKAHRIEISYVDRPTDKQVMKGIKTSIKNLTKYNVDVLGNKYKVTDEKLEFDVTI

SEQ ID NO: 917 - protein, 1013 aa, Cytophagales bacterium B6
MKKILAFDLGVTSIGWAYVLEAENPGEESSILKLGVRVNPLTTDDKDDFEKGRPVSVNAGRTLKRSMRRNLQRYKQRRKDLIALLKENGIISDTTILTEEGKLSTHATLAARAKAVTEKVSMDEFARILLMINKKRGYKSSRKVNSEDEGQLIDGMAISLKLKDEQITPGEYSLQLLKEGKKSLPDFYRSDLVAELDRVWNFQQQFYPDIFTDAFRKNIQGKGQKATSAAFWGTYGFNTAENKGNWAERKLQAYQWRSDAVSKQLSAAEAAYVVTEINNNINTSSGYLGEISDRSKELIFNNETIGQYLYRRLQHERIGTKNQVFYRQDYIIEFDTIWNTQARFYPELSGELKEKVKNTIIFYQRKLKSQKGLVSFCEFESKEVEAVKNGKTEMYRIGAKVCPKSSPLFQEFKIWQNLAHLQIQHKKQKEARYFDLEAKKLLFYELNIKGNLSKDEVLKLVGYSSKDWELNFTTIEGNRTNEALYQAYFKMMELEGHDEIEWKKLPADEIKATIASFFESQGLATNLLNFDAEITGSNFEQQASYQLWHLLYAYESDDSKTGNDKLYQLLQQKFGFNKSFAQILAKVGLQADYGNLSAKAIKKIMPFIYENNYSEACKLAGYNHSSYLTKDENDLRPLKDKLDLLRRNSLRNPVVEKILNQVVNLTNTLLATPGLGRPDEIRIELARELKKNAKERAEATSQINKTKNEHDAIRIMLMKEFNIKNPTRNDIIRYKLYDELKFNGYKDLYTNEYISREELFTAKYDIEHIIPQSRLFDDSFSNKTIVLRAINQKKDNATAFDFIQNTYDDNALSEYKLRLEAFVKFYPERKAKYKKLLLQGAAIGQGFIERDLRDSQYIAKKAKVMLEEVCRKVTSSSGSITARLREDWGLVNIMQELNIDRYRGLELTEMVEMKDGNFKERITDWTKRDDHRHHAVDALVVAFTKPSFIQYLNNLNARSRNDESGDTIWRIQQKETQIDADGKRRFKLPLLHFRSIAREHLENILISYKAKTR

SEQ ID NO: 918 - protein, 1084 aa, Sporolactobacillus vineae
MKYSIGLDIGISSVGWSVINLDRERIELMGARLFDAAENPKNGSSLAAPRRDARSARRRLRRRRYRVGRVRHFIIDRGLVTRGQADQLFDWKDGDLDIWLVRVNALERLLTDREFARVLIHIAKNRGYRSNRKSEAKSGENGQVLSAIKANKELMEEKGYQTVAEMLVNEPETFAGRKRNRGGEYTHVIARSELEHEIRLIFTKQRAFGNRFATEENENTYVKIWAAQRPVATKDDILKKIGDCTFEKGEKRAPKASYAFQYFRALDKLNRLRILSVREPSRNLTDDERNLIVPALFNHDKQKYSDLRKILQLRDDQKFNELFYDPGKSLKENENKTFLSLAEQYKIRKVIRDVQGKDGLLQYRPLDIDTIAYALTVFKDDQDTRDYLSNTFVNGNGKQVLNLANRAFDAELIDGLLSLSFAKFGHLSLKALHKLIPHMEQGLSYYDACKKVGYHDNEQVGKSKQHLLPVIPADEIRNPVVVRSLSQTRKVINAIIKRYGSPTFMYIELAREMGRPYNERRDLEKQYNKNRTVNDSAIEQIHELYPEIGAPRGHDILKYKLWQQQDCKCAYSLEKIPAEKIFEPGYAEVDHIIPYSRSFDDSNSNKVLVLSRMNQEKKNRTPYEWFGGDEHRWNKFESYVNALKVNRKKKSLLTKKNMDTEEEDTFKSRHLNDTRYITRFIKSFVEDNLLFREIEGAKQHVFTVNGAYTSLMRKRWGFNKNREESDLHHSVDAVIIAVSQPFRNEVSRYFKHREISLPQLLKRTWDYFPEPWEGFVKELRARTLQDPEKLKLALESLDLDSYDPEFIDEVKPIFISRMPKRSIKGQIHDETLRRNRGKTKDGFVKIVTRTRLENIKFDKNGDFPMYGRESDPKTYQAIKQRYLENNKDKKKAFIEPLYKPAKNPNNASLIRSVKIEDKANQIVPLRDEAVAYNASIVRTEVYRNKETGKFYLAPVYVSDVFAGREPRRFIRANVPYEQWVNITDKFTFLFNLYPNDVIYIKMKKVKTTKSNINKTISWQESYFYFKGTDIHTGAITIIDHMNSFTDRVGTQGLQLFEKYQVDPLGNLSRVHGETQYGVPALSHS

SEQ ID NO: 919 - protein, 1497 aa, Prevotella baroniae
MKTILGLDLGTNSIGWAKVSVDDHGNYLHDIKLGSRIIPMSQDILGNFDKGVTESQTAIRTGFRSVRRIRERSLLRRERLHRVLHVMGFLPPHYDSAIGWNREEASTYGKFLNHGEPKLAWERLEDGSMRFLFMDSFHEMMANFARHQPALVADGRKIPLDWTLYFLRKKALSQAVGKEELAWILLNFNQKRGYYQLRGEEEEENPTKREEYYELKVVSIEVAEEGKGGNTWYRVQLENGWIYPCPSKIALDDWVGKIKQFIVTTEYEKDGTTLKKDKDGEVKRSFRAPDENDWGLRKKRTESQLEDSGKTVGAFIYDHLLAEPVDKIRGNFIRTIERKYYKQELEAILREQSKHHEELQSREMLAKCAEELYQSNQPHRDSLMKKDMVYLLLTDLIFYQRPLKSKKSLIAECPYEYYKYKDKEKGKKKRQGIKCVAKSNPYYQEFRLWQFIVNLRLFDRTDDKEVTAEYLRSREDYARLFAYLNDRKEINQETLLKDFFGLKKVKIGAEKEFAIRWNYIEDKEKKYPCNETRHELLLALDRAGMDRSWLDDSELQYRLWHLLYSVEARDEAEGALHKLRDDDEFAGAFLKVKPFKKDYGAYSEKAVKKLLAVMRMGSWWHEEDICKQTRDRIERIVQGDIEEKIRERMGHAAYSFSHLADFQGLPEWLACYVVYGRHSEATHILRWDSPDKLLSYIKGFRQHSLRNPIVEQCILETLRTVHDIWKEAGHIDEIHVELGRRMKSTAEQRAHMTKNILRNENTNLRIKCLLMELKNDADVKDVRPYSPMQQEILRIYEEGALQQLTKDDTEYAEISKISKMAQPSAKELLRYKLWLEQKYRSPYTGKSISLSKLFTSAYQIEHVIPQSRYFDDSFNNKVICESEVNTLKSNMLGYEFIKNHGGEIVHCTMLGDVKVFSESEYKTFVTEHYSNNKYKKEKLLLEDIPQEFLNRQMNDSRYISKVVKGLLSNVVRTEDELEATSKFVVSCTGGITDRLKKDWGLNDVWNSIVYSRFERLNRLTKSENFGHWENKEGKRVFQTSVPMELLPGFNKKRIDHRHHAMDALVIACASRNIINYLNNEFAKSPKQREDLRQLLCEKNRIIRKPWETFTQDARAALEDVVVSFKNYVRVINKATNYYERYDADSKKTMVPQKGNEMWAVRKPMHKETVFGHVNLRRKAVVKLKEALENISSICNKELRDYINVLVDKQFNTKQLLAHFKSTDYRWNKQYIDKVEVWRFSDEKEPMVATRKLLDTSFDKKRIDAITDTGIQKILLNYLEAKGGDPAITFTPEGIAEMNQNIAVYNDGKKHQPILKVRVAETMGEKYQVGETGNKADKYVEAQKGTNLYFAIYEDEEGKRSYDTIPLNEVTERLKQGLSPVPEKNEKEVPLKCYLSPNDLVYVPREENGNELDKERIYKFVDSSGTTANFIPHRSAGLIYNVDKKIAESFCNGTIIQNEYGVGSPQSKNQKSLTGEMIKAVCWKLDVDRLGNILRVIK

SEQ ID NO: 920 - protein, 1431 aa, Prevotella nanceiensis
MTQKIFGIDLGTNSIGTSVRNTDLGNNLVDQLEFFSSDIFNASVSKNTNGREYSLASDRSAHRRGRRLNDSRRRKLWATLDLLIKNNLCPMAPESLEQWRTYDKKKKLFRQYPIDDKAFHSWIILDFNGDGKPDYSSPYQLRRELVSVQLDFNQPIDRYKLGRALYHIAQHRGFKSSKGETIAEQEKQEDDSKKNKNSALTEEHVDVVNAMKASEEKLSKGLLAYMQEHNLKTVGAAFAQLEDEGIRIRNNSEYKAIRSQHQDEIKEIFKFQKGLSEQTELLDTLISEKQGIGTIFYKRPLRSQRGNVGKCTLEPNKPRCPIGHPLFEKFRAWTFINNIKAKSPDSDSAEPLPMDMRINIYNKLFLSRVKADFKFEEIRHFIEKQWGVALSKDDKTINYRDDTSVAGCPITARMIKVLGEDWENFQVIGTKERQTQGKSNNALHQVCYTAEDVWHLCYDAEDPEQVRVFAEQTLGWDEKKAAELVRLWSAIPQGYAMLSQKAIRNINRMLLFGLKYSDAVLLAKLPDILELLDEDIQTIIKKAQQLEEVVNEEKRIGNIVNSLIANYKAESLEHRFADHNYEYQLDESDEREIIKHIESNIGKQRWELMDADEQISILEGVRSGYQAFFASYKRNYIELPQLGERLVELLSKEYPSVEKREWERLYHPSQIAIYRPILLDKSEQNLRLGDPNIGAIKNPTVMRTLNNLRRRVNQLLDDGVLVPSETRVVVETARELNDANAKWALEKYQKTRRDENAQIKKILEEFYSKPNGITDTDVDKARYVIEQCEEDNYKSKKEIGTYSKDIQKYKYWLEQGGQCLYTGRIISLSNLFDSNAFDLEHTIPASVSFDNSDQNMTLCEAHYNRFIKKNNIPTAMPNYEKDVTIDGKLYTAIKPRLEKWKKRIERLSRNVEYWKVQARRAQMKDRKDECTKEKLLWQMELQYWRDKLQRFTILEVTDGFKNSQLVDTRIITRHATLYLKSVFENVEVQRGSTTAEFRKILGVQSVEEKKDRTLHSHHAIDATILTTIPTAAKRERILELFYKVQEKERILKNCSGDVCEGLKQDLEGLQAKLKKEVADCKLGGEISQLGNFINDKIIINHCVKDQTLTPSHKRLRRRGRVVGGKEHPIWQTGDTLRGEIHAASYYGAITQYAKDKDGNVLFNDGKPKIDPTIWYVIRRELKHKKSPQDTGFASWDDLEKVIVDKNLFKLMKEQFPEGTSFKDACEQGIYMIKKGKNQEHNIKTHRIRHVRCYAVKTALKIKEQTNKSTKEYKQYFYAAVGDLYTMCCYTNGKNKEYRIYSLYDIAQHRKAGIEDIPEFITDKKGNRLELAYKLRKGDMILLYENTPEELYDMDPVNLKRRLYKVNGFENDGLRVRMTNHMVANKEMGESIKDYSQIPVAARCGIKTIKFLIMGEHNDFVIKGNNIIFNHR

SEQ ID NO: 921 - protein, 1210 aa, Prevotella saccharolytica
MKLVLGLDLGVGSVGWALIFITDSGEPIKILALGERIVSMDPDNSKEFSAGATCTLNQKKTKAKSVRKGYSRYVQRRDALTAELRHIGMMPDETLIKLPVLDLWQLRANAATEGKKLSLAEIGRVLYHINQRRGYKHGKSDVSSDNKQKGYVKAVNERYCMIQERQQTIGQYFALKLKETAVTTEKGTFYTFRIKDQVFPREAYEEEFDRIIECQKKFYPELLTEKVIDKLRNYIIFYQRHGKSCKHLVSVCDFERKPYKDENGKVFYNGPKVAAKSNPLYQIEKIWEEVNNISLRNKKGEELEITLVQKRELFNYLNTHEILRLTVLYKILGISKRDGWSANDAVKRGLKGNTTFVQLQKALQGVEDCEELLRFQLNNMPTVVCDEVTGESLQMVNPDCIGQPLYRLWHAIYSLKDKRQLKDTLRKNFKIEDDEIIDLLYNIDFTKDGYGNKSVKVIRRLLPYLQAGLKYNEACEYIGINHSNSLTKEENAQRVLLEKLPQIGKNELRQPIVEKILNQMINVVNAIIAKYGRPDTIRVELARELKQSKEERKLMSDGIAAREREKKRDGKILEEEGIHPTKNRLERYRLWKETGERCLYCGNGINLNEFLRGGEVETEHIIPKALLFDNSYSNKTCSCRECNRKKGRRTAYEYVSSLGEERFEVYLNVVKMLYDEGKISKKKMDWLLMKSEDIPQDFINRDLRQTQYISRKAMELLQKVCYDVTVTSGHVTSFIRHIWGYDTILHKLNFNRYKQGGLTEVVQFEHRGGKHEREVISGWSKRLDHRHHAIDALVIAMTKQSVIQRLNTLNTCRDEMYQEVESEKKEWRDDYSLLEQWLRELKHFSVEEVQRVIAKTLVSYKVNKKITSPGTRAVYSKRKKKVVQRGILIPRGVLHEDSVYGKIKIQGDLDPVYVIKYKLGVGAMGFVFTGKETYEETIKSNKKTGLEEVKVKDDIGNTLMSIVDGNIRNRIKQRLNIGFPEGEDYRNNPQKALENLKDLDNYPLYADDACKIPIKSVRCRTGLSAVVPLRYNGEGQAVGFVKTGNNHHVAIYRDRDGGYHESIVTFWQAVSRKRFGIPAIIEQPPALWESISSGLQREIPKSILETFPEPEWTFIVSMQKNESFILGMEEDDYQRAMEEKDYAALGNNLYVVQNISSMVYRFCLSTTTIFDSQKMNKPDKRFLNIQSFQAFFDKNPHKIKIDLLGEIVNN

SEQ ID NO: 922 - protein, 1130 aa, Lactobacillus nodensis
MENKISLGLDIGVASVGFSVIDAQEGKVLELGARLFNSSVSAENQTRRDMRGSRRLSNRKKQRRKDVAQLFKTFGLINYFDKENYFDNFQNNLNSYELRVKGLSEKLSKEELVNSLYHIVKRRGISYDLADADTDFDGSDYSSSLNQNQLELQTKTPAEIQLTRLNVHGAVRGKVTINGEDEDTMQVLLNVFPTKSFVSEAKKIIQTQQQYYPDILTDIFETKYLEILERKREYFVGPGSEKSRTDFGIYKKDGRTLDNLFEELIGHDKIYPDELRASGASYTAQVFNVLNDLNNLRISSYENGKISTEDKIKIVEDLRNNIGNVIIMKIIKKVAGCEDDDIKGYRLDSKDKPDIHSMAVYRKVHRDLLKYDVDIIKWPTEFIDELSPILTLNTENGEIRKQMVNKLQPKYSFLTDELIQVIINNKSSFDVTSNNKWHRFSLKTMNVLIEEMFRRPVEQMTLIQELGLIKDSGKRFENCKLLPYREISKDIFNPVASKSVREALKIVNAVMKKYGQIDYLVIEMPRDKNEEEMKKQIEKFQKENNKQKDEAINEFVKKIGNKNAVDDGLRRYGGKLYFKIRLWYQQDGIDLYNGKVIEPFDLLNNINKFEVDHIIPESISFDDSINNKTLCYADMNQIKGQKTPFEFMNEGHGQGFAKMKAMVNKNSKLKGKRKNYLFDENISDIETRKRFISRNLVDTQYSSRVVLNSLQEFFKEKETGTKVTVVRGKFTSNLRKHWHINKTRDTFHHHAIDASIIAATPFLRIWKKDASLFPMHVSENTVDIETGEILNDTEFKKDFYGLPYSSFIEELNGADDRIKFSHQVDRKMNRKVSDATIYSTRKGMLNKDKEETDYVLGKIKNIYDVSEYNKFKRIYDKDPNKFLLAHHDPKSFDELRKIMQEYPSKIDKVMTNGKVKSVDISPFELYRRKHGMVQKYSNKNKGPVIKQLKYLDKKLGSHIDITPKDTLNDRHVVLQSLKPWRTDVYYNSVTGEYEIMGIKYSDLKFNGGEYGIKMSKYLEIKEREQVSDESEFLFTLYKRDRIQIINCENDEIVEMLFWSRNNSNIGYAELKPVYKYKTEDESWPVYGYGKNQILKRLVPKNCKILKVNTDILGNPYYIKKESKNPKNILD

SEQ ID NO: 923 - protein, 1135 aa, Tenacibaculum maritimum
MSTILGLDLGTNSIGWALINNTTSKIIGVGSRVFSEGVVDLGGGEGKEMSKNASRTVARGVRRQLFRRRLRKRYLLKELAKHQLCPIAPEALENWNQTTVFDTEVLKKWFQLNPYELRAKAIKAPISLHEIGRIFYHMIQRRGFLSNSRSAGAATKETSAIFKGDLKQEKVGIASTQQSIAQSITLGSYLHTIQPKEHAPYVKKVARIRNRYTTRQMYIDEFEMIWEFQKQFHAVLTNSLKTHLGGRKKDGYKKDGILFHQRPLRSQKHLVGNCTLEPKKTKASISSIPFEYFRIYQWINTLACDFNGNHHPISQKERHQIITLLLSAEKVAFKKIRKAIGKTEKEYQFNYKDDAIIYGTHTISNLSNKKFFGKQWFNFTQEEQENIWHILSFFDDREKLKNYAMTHWQFTEEKAIKISKFNLKEGYANLSRKAINGILPFLKEGFMYDVAVALAGVKNALGNTWQTHQEFVKNNVPEIVRANIKGGYLAPLKKMLAATLACTPTQLKKLYHHSSAIKATTIAPKLPVGDIADKEIQKIKNPIVIKALFEVRKLVNELITTYGKPDEIKIELARDLKTSKKNRYEIRKQQQFLEKENNRIQKELENLAQRATPTNILKYKLWEECNHTCPYTNTKIPIHKLFTGEIQIEHIYPWSRSLNDSFMNKTLCYANENRAKKNKTPYEFYHDEQGEEKWAQVKQQALACFKNKYPNYPNAYNKFKHFVQKKREEDFVSRQLNDTRYISKEAKNYLSKISNNVLVASGQATAALRHHWGLNSILNEVENAKTRHDHRHHAIDALVMACITAGHVQALSQWNRYDRNYELKDFAMPWPSFRVDAAVAIAGILVSHKKEKKLLTVRKHTVIKNGQPYTNKGIAARGLLHKESVYGKRKAPGKEEAYHIRKPIESITTEKKLEKVVDPTIKNLIFKRIQKLGGFVKGKIPSETFYKLAENGQRVPQIFLPNKNGAPVPIKKVRIREVIGKAVPLKNTVNQYVNPKNNHHILIYKNAKGIMEEEVVSFWEAVERKKQEIDVFKMPKKGKEKLAILQKNDMFVLGLDIETVEEAWQDNSLLKEHLYKVQKISSKDYNFRKHSDARPDEAAKKEYIRITSLGEGKKGWKTMNPIKVKLNSIGKIVKA

SEQ ID NO: 924 - protein, 1133 aa, Methylophilus sp. OH31
MNSKQALKYSIGLDIGIASVGWALLGENRIIDLGVRCFDKAETADKGESLNLARRSARLLRRRLRRRAWRLTKLARLLKREGLISDVNILKQPPAKGFTTPNLWQLRVEALDRKLNHEEWARVIYHLCKQRGFHWLSKAEEKKADDDKEGGAVKKGLAGTKKLMQDKGYRSAAEMVITEFPDAQRNKRGDYSKALSRELLSTELQLLFDRQRALGNLSASSTLEDKLLERKHGLLWAQKPALSGEALLKMLGKCTFEKDEYRAPKASFTVERHVWLTRLNNCRLIIDGEKRALTPAERVLAIQLPYDQSSDFTYKQFRKALVKAGLTNEFRFAGLVYPSQSEQEKAKDPEDEKLIKLPAWQQLRKAMKEANLESEWQKIAVDALDGKAQLYDEIARVLSIYKEDEEVERELNKLDLPNKSCMVEVLQTVRFEQFSNLSLKALYNILPHMEKGHRYDEACLAARYHHSQLHHTGTDEFQYLPLFYSGRDRDGRLKFNEDLDIPRNPVVLRALNQARKVVNALIKKYGSPDQVHIEMARDLSKSFDDRRDIKKAQDEYRDRNEKDRTTFNLEFNTTGELKGRDFEKWQLYREQHGKCAYSLQALDINRLFEMGYAEVDHALPYSRSYDDSKSNRVLVLAAENRNKGNMTPYEYLGGAQNNLRWLEYVAFVNSNKTYRQAKRNRLLRKDFGEEAAREFSERNLNDTRYICRFFKNYIERYLKLADTSDSKRCVVVNGQLTSFLRARWGLVKVRADSDRHHALDAAIVAACSHGMVKRLADYSRRKELETAREGFVDITTGEVANHAMYTQLEQHFPFPWLHFRQELQARLFADDLPALRNELQNMGYGADALENVKTLFVSRAPQRRNSGAAHKETIYGQSEKLAKTGSVTQKIAVTDLKLSDLDKLIDPHRNQKLYAEITKWLKGRDDREKRAKEIEASLGRGKDKRETTSEEKAEIEGLRALPRKPTNDDTPGPVVRTVTAVIDKLSGIPIRGGVAKNDSMLRVDVFSKAGKFHLVPVYVHHRVTGLPNRAIVANKEEGDWSLVDETFDFCFSLYPNDFVRITLKNELREGYYSGCDRATASVSLWVHDRNASVGKDGLVRSIGVKTALNVEKFNVDVLGNIYPAPKETRNDLA

SEQ ID NO: 925 - protein, 1341 aa, Lactobacillus lindneri
MTQKVIPYNIGLDIGTNSVGWAVTDNENKLLHIKGHNGIGVRLFKEGQSAAERCGFRTTRRRLSRRKWRLRLLNEIFADKIAKVDPSFFARLKQSNVSPKDPNKTMFGNILFDNGNLNDKSFHDEYKTIYHLRQSIIDHPEKKFDIRLIYLAMHHIIKYRGHFLNQANVQDFKGGKIDLEESFKDLNSIFENQGRDLRLVTEDANKYVKELSDNSKTRNDRQKELSKVLYIPIDKNSDKNNKKVTTEIIKAILGMKAKFDVIFGIDAENAKEWSLTFNSDDFDDKIEGLSAQMTDEAGEILLILKELYFALNLSDILNNSVTDKNAKTLSEAMINRYDDHKEQLTMLKQVIDNSDKKHAKALKAAYSAYIDGENNKKISFEDLRKRIQKNLDNSETSKKINDLLEHDYFLPKQRSKENGAIPHQLQQQELDKIIESQKHYYPFLAELNPNEKRSRQAKYKLDELVAFRVPYYVGPMVKATENNQSNNGKFAWMIKNDNISDKLKKEEITPWNFDKKVDRTETATKFITRMTTTDTYLIGEPVLPKNSLLYQKFVVLNELNNLKINKQPITPEQKQYVYEHVMKQTKRVSLKKIADALVIKGDYPYAPEITGTTDQKNMNNGLSTYIDLAKIFGDELDDIDRKEDFEKIIEWSTIFEDQHIFALKLKEIKWLTEDQRKQVVKLRYQGWGKLSKKLLADLVDDNGQRIIDLLWDSKQDFMQIVNQNSFKQAIAEHNGAHLEEKDLKDIINNLYTSPQNKKAIRQVILVVDDIIRAVGYEPVNIMMEFAREDSKDHRLTNSRSRQLEKVYKDITNSWFDDDNVKDELKDKIKDKAKFTDRLYLYFTQGGKDLYTGEPLDIDNLSNYQIDHILPQSFILDNSLDNRVLTSKINNQIKKDNLPGEFFGSKMHNFWKHLKELHLISNKKYYNLTLTPNSISKFNNQGRFINRQLVETRQVIKLAAEILHNRYSEENGTNIVTVKANLTHHMREKFNFYKNRNVNDYHHAFDAYLAAFVGNWLLQQYPKLKPYFVYGDFAKTEIDNLKSFNLIYKFEQAHQLNEEDGKIAKDTDALLGYMKNVYHFKKMLVTKELETNHGNLFKQTLYPSHGKMKNLINPKENRSSDIYGGYSSETGAYVSLIKVFKKNKIENKIIKIPLLYIDKLNRQANAKQFIRNFIIKDDSNKFDILSEKIFLNQLVIDGDELFTISGSGDRQNAQQLILSDKSLKILSKNINVISKNDLIIIFNEIIDDICKYMKMYEVENSDETKAKFEEINDKDRMLKIINDLLLGLHANASRSNLSSIGLSPSFGRFFSGNAGIKLSENAKFIYQSPTGLFSRKVKISDL

SEQ ID NO: 926 - protein, 1245 aa, Bacteroides coprophilus
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWLMSI

SEQ ID NO: 927 - protein, 1125 aa, unkown
MIRRKERHMNWRLGLDLGTNSIGWSVLSLNGRNEAEKLEDMGVRIFSDGREPKTGKPLAAARRTARGIRRNLLRRKIRRRTLFRLLQKDGLFPSLRGEAAELKQLDPYALRAKALDERLEPHELGRALFHLGVRRGFKSNRKDAQNEQDDKKKEKSEQNEKIQCFKHELKNGQMRTLGEYLFETKEFRFSSNANLKNFYPDRQMYEDEFAAIKAKQEPFYPALGWDAIHEAIFKQGKLEPQKRGKCQFMDEERTFKATPCSQQFRILQEVFNLTYTDVITNKATELSPAQQDALIAALDNKKEMSFSSIRTLLKINGTFNLETLNRDKLNGNATACEMRKDTHFGKLWDDKMKLAEQDALIETLITTDEDSEAERFLKKYPLTSEQRKAILRFPFPSGTASFCREATEALVATMRETRLQYDKAALVLGYEHSDQSVEQYDLLPYYGKALSGSTMGVKATPGTNPDELQYGKIANPTVHVALNQTRAVVNALIKKYGKPAQIVVETSRDLKASKEKREEITEQQKQRARQNDIDNQSITDGFRISFPNRSDRLKYRLWVELNASNAFERQCLYCGKQINAAELFSDNIEIDHILPFSKTLLDVESNKTVAHWKCNQIKGGRTPYEAFHANPAGYKWEAIRGRIAQLKNPAKRRRFSADALTEFEDKEAFIARQLKDTQYIARINLQYLKTLVDDTNIWATTGRMTGLLRERWDLDSILKRDTDGIKQKIDELSDNGKKIAEAEKAKLLREAKKNRRDHRHHALDAVVIGLVDHALVKKIMTENARGNLDKVKVPLFPLWAEIIEKMRNIVVSFKPDHGAQGKLSKETALGRIRQEALLPIEKLTKDDVPHIKDTRVRGAFEQRLAETKDFKAAVKEMQTDYPRIRVFRPCFVNRIPLANLKNKQNIAGIVDMGIQNKLREFVDAHPNEKFDKALVKFSEQTGIKRIRYKNHDQNPWEIKTRKNKSLPEEQRRYYGTEDYFAAIIWEIPPTKTGAKPEYKAQYVRRTEIDTDSNLKPEALANKPHPAATKICQLHKNDYIEFAENGVWKKARIAGLKGSDGRLDIRPIYATDDARSWIIATAEQMLEKSWKPVEGQNFVSVNVLFGKYAAHKIRVSPIGAVSRKAT

SEQ ID NO: 928 - protein, 1021 aa, Demequina sediminicola
MTGTDATAHSHTPYRLGLDVGTGSLGWAVVELDTDGNPVRIVRTGSRIYGSGRKPKDFSSLAADRRAARQMRKQRDRYLQRRTRLMHELVAAGLMPEAEVERQKLKDLNPYLLRARGVKEELTAHELGRALFHLQQRRGFKSNRKTDRKDDDRSAMKSAIASLQSDLGDDTLGTYMWKRIQNGESVRSRPRKVGSKNEYDFYVNRAMVEDEFNQLWDYQSQSHGDLLTDEARIRVHDAIFSQRPLKPVDPGRCTFETDQRRAPKALPSSQLFRIYQELNAIRVIDPFSSDQADRPLTRQERDAGASFLLGRVKATFPQLKKAMFGPTKLQLSLEYGERKNILGDVVGSELRKAQHIGPDWETYDLATQDLIVTILLEADTDDEVIERLQAESSLSLDQVHGALEAPLPDDYLRLSHRAIGKILPHLKDEWNEEGNAPVMYDAAVRAAGYQSHSEFHSGVLEDTLPYYGKVLKRYTQEVSGSSQAATNPDEWEFGKIANPTVHIGLNQIRTVVNSLIDRYGLPTQIHVEVARDLGQSAEGRREAASNRAKNERANEALNARLTELGQRTNFANRERLRLYDEISVLNHRCVLTGIPIEMSRLFTNDYQVDHILPFSRTLDDSRGNKILVHHTANQFKGARSPFEAYSETADWDHILQRASDAFGATSPKFKRFSADAMDRYSNGEQDFIARQLNDTSYLARVTREYLGSIVDPDRILATPGRLTSLLRHHWGLNGLLSDAAEKNRSDHRHHAIDALVVALSERVTLKAVTDANRRAGDQGIERLLVDLPQPWEGFADHARESVDRIVVSHKPDHNEKGQLHEETAYGVLEGPDKKGRFLTRKRITDPAKGVVGSWEQPKWRDVIPLYRRGEGPDSTLPYKAYIGGSNYCIEIVRTAKGKWAGEVVSTHTANTAEYRAFMAEPGAYRAQSYAGGDLVMRLIANDTIAIEVGDAGRQIMRLCQLETVGAMYFANVREGNVAARSRARDNDFSLLKKAASTLQPLKARRVFVDPIGRVFDPDFKE

SEQ ID NO: 929 - protein, 1376 aa, Candidatus Symbiothrix dinenymphae
MEKILGIDLGTNSMGLTLRDDNEFSWYGVYTFKKGVGEGKSGEFSYAAECTKHRSSRRLYNARRYRKWETLKVLIDNDFCPLSEENLNKWKHYEKGLGRFFPVNDIAFQQWIKLDFNNDGVPDFTSPYQLRKLLIIEKLDLSISENRYKVGRALYHVAQRRGFKSSRKSGANEKTAVYKGSNETKTIGRNEYENLIIEHETLGAAFAYLENERIRVRNRYTLRSDYQQEVQKIITFQKIENREFAEQIEKAIFFQRPLRSQKGLVGKCTLETNKPRCPISHPKFEEYRAWSFINNIKYRIDNHSDFEPLPLDLKEKIYHEIFFFKSKREFLFSEIRKFIQTNGGRNWELNYSPKMDGISVPSCCVSARLKSVFGNDWHFFEKIVVKTNKKGENETITYTIDDIWHILFSFADEENFIEFCAKTLELDDNQIKELTTLFNSFPVGYANLSLKAIKNILPFLREGLIYTESVILAKIPEIISEQLFKEHKNIILAEIKNEIAKNRYEKMIITVVNNLIFKYYALDYNERFAWKDFSYKLNESDFKDIEKAVIEHFGEKSWNKKSDNEQQKFLSDVTEKYQTFFADEKREHIKPPHLVNQIKEFLLAKFDVAEKKLNKIYHPSQIDIYPKKEDQQLLKSPKTAAFKNPMAYKTLYKLRDVINYLVETERIDKDTRIVVEIARELNDANKRWAIEAYQRRRETENLVFKAAITELIKDTNFKGFADPESSEDIDKFRLWTEQTDNYEETSKAIAEIDKNKNISDKDIQKYRLWKEQNCTCIYTGKIINLTDLFDQNKVDFEHTIPRSKSFDNSLANLTVCYADFNRNIKKNKMPTELDNYDEIKNRLEAWEKKVDDLEKQIDFWKTKSKHAQDKDEKDNTIRQRHLRQMEYDYWKNKLDRFTRTEVSQGFINSQLTDTQIITKYAFHYLKTVFDKVDVLKGTNTAQFRKIYGIQPKFEKKDRSEHSQHAVDATVLTLIPSAKKREEILKKSYEFEEKPENKNRQYHEKPFSSFNHSMIEEIQKNILINNLADKDQTLTPGEKIVRKRGRVVWLDKENRIPKIAQGDSIRGELHLQTYYGKIKIAAKDEQGTLQRDEDGNILYNQIDGKDEMWMVLRKSIESVNFNTDVIVDVHLAEHLKAQLSKGIKQTELEDFQGNKLRHLRCRVKAARGFMNSENATIVKEHVYKSEKDYKNFIYAASGENFLFALYENEQGKSIVPFNVFEAAKYSKYLDNINYVDLYKSKEPIYIGRGANKKVATLKHIFQVGQKVLFFNEQKEELFDLEQEDISKRLYYVKTLFDANTQRIIFQHHLEARSNEQLLIDFPKEQFGTKGKDGFSKFTADFIAPRLLLTPSNFNFIIEGKDFEMKLDGTIEFKEADV

SEQ ID NO: 930 - protein, 1315 aa, Fructobacillus ficulneus
MGYSVGLDIGTGSVGWVVTNEDGKLARAKGKNLIGVRLFKTAEPAADRRTNRTTRRRLSRRKWRLRLLDELFANELGKIDSNFLTRLKYSYVHPKDDANRANYYGGYLFPTQEETKKFHAKYPTIYHLRLALMTESRQFDLREIYLAMHQIVKYRGHFLNSQSKMTIGNTYNPQDLQTAMENYAEAKGLSIELKQPEEMVAILTGEAGFGLSKKAKAEKLLNNFFFDTKEEKATVQAILAGIVGNTIDFTKVFNRQLTGDTLKAWKLKLDSETFDVDSEPILSDLDDDETELFFAIRQAFDGFTLMNLLGDQTSISAAMVERYTQHHDDLLTVKQVAKKQGLSHKEFSNIYSAFLKDDTDKGMKKLLEESNLSTEDVNGIQLRMDSHDFLPQQRTKANSVIPHQLHLAELEAIIENQGQYYPFLLETFEKEGTAANKIAELLKFRIPYYVGPMVTKKDVENAGGDATNHWVTRNEGYEKSAVTAWNFDQVFNRDQAALDFIQRLTGTDTYLIGEPTLPQNSLKYQMFTVLNELNNVKVNGRRIDNQTKHDLIQDLFKSKKTVSLKAFQDYYQSQGKSDIQVVGLADKTKFNSNLSTYIDLSKTFSAEEMENPQNQDLLEQIVEIQTVFEDSKIAERELSKLELTPEQVTKLAKTHYTGWGNLSNKLLTTPIVDVSGKKVSILDQLAKTSKNFMSIISNEQYGVQDWIKEQNTTETTGTLEDKLADLTTSPANKRGIKQAFNVLFDIQKAMKSEPDRVYLEFARETQTSVRTMSRYNYLKGLYQSKSLDAEAKNLKKELAETDQKKFDNDRLYLYFQQQGKDMYTGQPINIDKLSSDYDIDHIIPQAFTKDDSIDNRVLVSRPENARKSDSGTYTTEVQAAASGLWKTLVQSGFISRKKYDRLTHAGDYSEGQKTGFIARQLVETRQIIKNVAALIESEFDQTQAVAIRAEITGDMRRLVAIKKHREINSFHHAFDALLITAAGQYMQKRYPDRDSNNVYNEFDRYTNDYLKKLRESSSKDEVRKLKPFGFIVGTMAKGNEDWTTEQTEYLRHIMNFKNILTTYKTGPDRGPLSKETIYAVDPKAKLIGTNKHRQDVSLYGGYTYPYSAYMTLVRANGKNQLVKVSRSAASLMKSGQLKLEDYVQQQPEVKKFEKILLEHLPLGQLVDNDGKLMYLTSYEFYHNAKQLWLSTENADLISSLSIDSDDQKLIKAFDILTADSVIERFPFYEIDLKKLIELRDKFVLIDNKLDVLRVVLKALQLDSAQQKPLKLIDKAATDWKNYRQAGGIKLSDNAEIIYQSTTGIFEKRIKISDLL

SEQ ID NO: 931 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 932 - protein, 1104 aa, Jeotgalibaca dankookensis
MGYRIGLDVGIASVGYSILKTDSYGNPYRIEFLNSVIFERAEQPKTGASLAAPRREKRGMRRLNRRKQFRKHRTKRLFIESGMLSEDEITHIFENTGDRSIYQLRTEALDHLLTNQELFRILYFFAGHRGFKSNRKSELTEKDNGPVISAIKDIQKDLTDKDYRTLGEYLYKDDKYAEHKRNKEHTYIGTAERNMLVEEINLLLTKQQEFGNEAITPEFIERFIGNGEKPGIFNQQRDFDEGPGAQSPYAGDQIEKMVGYCAFEPTEKRAAKASYTFQYFDLLSRVNNLKVQEMVGAEYKHLNHEERRLIIDKAFEKEKITYADIKKMLNLGEHARFNLLNYGSVKDAKKTEKTNFIHLKSYHTLKKTVGKEEFSHFTKSQIDEIADILTKYSSDRKRIEKFKERTTLTDEQIDKLLPITFSKFGNLSVKAMQNIIPYLELGDIYSEAATNAGYDFRHNKIDWEYIEENVMNPVVKRAVSKTIKVVDQIIRKYGEPDAISIELARELGRSFDDRKKITKHQEENRARNEKVAKRLEELGFPVNGENITRLKLWEEQGNFDPYTGIEIPLEQVFTYMYDIDHIIPYSKSFDDSYTNKVLTSAKCNREKGNRLPLEYFGNDPLRVAALESVMKSIHNKRKRDFLLKKKLSKEDISEWKQRNLQDTQYISKLLRGYFDQNITFSKELDKKQRVFVANGMITSRLRARWGLNKVRDDGDKHHAMDATIVACITPTLTRMLTLYSRRQEVKENPNLWKAYEESEDPELAKMTSIKREQYEKIFSKYFPQPWPGFSQELIMRLSDNPKELIKAQGFEEARKLYTPEEIEELKPIFVVRMPKRKISGAAHLDTIRSAKLLDEGKTISRVPVNKLKLDKNDEIVSGNAHFYRSTDKGWTIVYEALYKELVKHNGDGAKAFPEGELRYSHNGNEHVVRKVKMVQKSTLQATLNDGKSVADNGSMVRIDVFKTPKKYVFVPIYVKDTVEEELPNKYVVPLKPYSEWIKVVEDEFLFSLYPRDLVHIKSKSGIKPIFTNGRKAEKNEIIHDFLGYFVGADIHTGSIQVISNDNAFKTRGIGFATLPKIDKYTVDYFGNYQKVTEKKRQTFNRKKG

SEQ ID NO: 933 - protein, 1369 aa, Lactobacillus gorillae
MKEYHVGLDIGTSSIGWAVTDSQFKLMRIKGKTAIGVRLFEEGKTAADRRGFRTTRRRLKRRKWRLHYLNEVFAPHLQEVDENFLRRLKQSNIHPDDPAKNQAFIGKLLFPDLLKKAERGYPTLIKIRDEAPEEERAHYPVTNIYKLREAMINEDRQFDLREVYLAVHHIVKYRGHFLNNASVDKFKVGKIDFAKSFNVLNEAYKELQNGEGSFAIDLDQIDEIGKLLLDTSKKKLDRQKEVAKLLAVKVADKDETKSNKKVATAISKLILGYKANFATDALVDDKANDWKIDLSSETSDDDIEKFSGELNDAQNDILTEITSLFSQLMLNEIVPNGMSISESMMDRYWTHQRQLAEVKKFLATQPSEVRKSFNSLYNQYIGQEPKTKGYDFEKGLKKLLKEMPNWKEIEGQLKAGEFLPKQRTSANGVIPHQMHQQELDRIIEKQAKYYPWLAKKNPATDDRDRHKAKYELDQLVSFRIPYYVGPLVTLKDQERTSGAKFAWAKRRAAGEITPWNLWGKIDRAESAEAFIKRMTVKDTYLLNEDVLPANSLLYQKYNVLNELNNVRVNNHRLSVGMKQDIFNELFESKKTVKASDVASLVMAKTRGVNKPMIEGLSDPKKFNSSLATYLDLKAIIGDKVNDNRYRDDLERIIEWRSVFEDGEIFADKLTEVAWLTDAQRSALGKKRYKGWGRLSKKLLTGLVDENGQRIIDLLWNTDQNFMQIVNQPVFKEQIDQLNQSAIAKEGTTLGDQVESILDDAYTSPQNKKAIWQVVRVVNDITKAVGNAPKSISIEFARNEGNKGERTRSRRNQLRSLFQNQARELVKDTSLLEELENTPDLSDRYYFYFTQGGKDVYTGEPINFDDIPTKRYEIDHILPQSFLKDNSLDNRVLVSQAENSKKSDRVPAKLYATKMRPYWEYLLKQGLITKQKFENLTLDIDQIVKYRSLGFVKRQLVETRQVIKLTADILGSMYRDAGTDIIETRASLTKQLREEFDLPKVREVNDYHHAVDAYLTTFAGQFLTRRYPKLRSFFVYGEYMKFTKGTDLNLRNFDFFHELVKDKHEKNNEDKKVYDDRGMLIISRSSLANYLNQIIRMKIMRVTKEIRIENGMLYKATINSTKNLGNVNIPLKKEMPVDLYGSYLSKETSFMSLIRIKGQRTARIVRVPVDALSKLSKYEKHSKEYLDELYKTIKNNNNIINDFIIILPQLGFNQLILDKVGGERVSYRLGGYDTKHLATELVLKKETLKKINNNFSEIKKSDNPSQEFDELFDEIIKTSAKYLPLLRKKILKIESNRRKFYEADVVKKERELNNILAAIHANNGTRHDLKTLNVSEFGRIRCAITLTKDAEVVFESPTGLFIRRLKISNI

SEQ ID NO: 934 - protein, 1345 aa, Streptococcus orisasini
MTKPYSIGLDIGTNSVGWAVITDDYKVPAKKMKVLGNTDKNYIKKNLLGVLLFDSGNTAEDRRLKRTARRRYTRRRNRLLYLQDIFSEEMSKVDESFFRRLEDSFYVPEDKRDAKHPIFGTLDEEKAYHKQFPTIYHLRKHLADSSEKADLRLVYLALAHIIKYRGHFLIEGEFDTQNNDVQGLFDEFLVVYDNTFENSSLHVQDVQAEEILTDKISKSAKKDRVLKLFPNEKSNGRFAEFLKLIVGNQADFKKHFELEEKAPLQFSKDSYEEDLEGLLTQIGDDYAELFLSAKKLYDSILLSGILTATDVSTKAPLSASMIKRYKEHQTDLAEFKKFIRQNLPDKYNEVFSDTSKNGYAGYIDGKTSQEDFYKYLKKLLAKVAGSADFLDKVEREDFLRKQRTFDNGSIPHQIHLQEMHAIIRKQAKFYPFLAENQDKIEKILTFRIPYYVGPLARGNGDFAWLSRKSNEKITPWNFDDIVDKESSAEAFINRMTNHDLYLPDQKVLPKHSLLYEKFTVYNELTKVKYKTEQGKTSFFDANMKQEIFDGVFKVYQKVTKDKLMNFLEKEFDEFRIVDLTGLDKENKAFNASYGTYHDLRKILGKDFLDNPNNEKILEDIVLTLTLFEDREMIRKRLENYSDLLTKEQVKKLERRHYTGWGRLSAKLIHGIRNKENRKTILDYLIDDGNSNRNFMQLINDDALSFKEEIAKAQVIGDGDNLNQAVSDIAGSPAIKKGILQSIKIVDELVKVMGHNPENIVVEMARENQFTNYGRRNSQQRLKGLTDSIKELGSQILKEHPVDNSQLQNDRLFLYYLQNGRDMYTGEELDLDYLSQYDIDHIIPQSFIKDDSLDNKVLVSSAKNRGKSDNVPSEEVVKKMKSFWNKLLKAKLITQRKFDNLTKAERGGLTDDDKAGFIKRQLVETRQITKHVARILDERFNTKLDENNKKIRQVKIVTLKSNLVSNFRKEFELYKVREINDYHHAHDAYLNAIVGKALLGVYPQLEPEFVYGEYPHFHGHKENKATAKKFFYSNIMNFFKKDDVRTDENGEIIWKKDEHISNIKKVLSYPQVNIVKKVEEQTGGFSKESILQKGNSDKLIPRKTKKFYWDTKKYGGFDSPIVAYSVLVIADIEKGKSKKLKTVKNLVGITIMEKVTFEKNPVAFLERKGYRNIQEENIIKLPKYSLFELENGRRRLLASARELQKGNEIVLPYHLGVLLYHAKNIHKIDELEHLNHVEKHRDEFKELLDIVSNFSKKYTLAEGNLGKVEELYAQNSSKDINELASSFINLLTFTAIGAPAAFKFFDSNIDRKRYTSTAEILKATLIHQSITGLYETRINLSKLGGD

SEQ ID NO: 935 - protein, 1153 aa, Lactobacillus farciminis
MTDRISLGLDIGVASVGFSVLDIDKGKVIELGARLFNATVAAGNQDRRDMRGSRRLLNRNKQRRKDVSKLFQEYGLLDNFDRDNFHTAFNNNWNPYELRVKGLTKQLNKEELADSLYQIIKRRGISYALKDADANEDGTDYSSSLKINSQELIEKTPAQIQLQRLNDYGKVRGKVIVGDDIDDQKVLLNVFPTNAYEKEARQIIATQQQFYPEILTGEFVKEYCQILTRKRDYFVGPGNEKSRTDYGIYKTDGRTLDNLFEELIGHDKIYPDELRASAASYTAQLFNVLNDLNNLRILSYEDGKLTQIDKEKIIAEIKNNTTVVNMLNVIKKVTGCQKDDIKGFRLNEKDKPEISSMPIYRKAHKDFLKVGIDITDWPIDFIDRLSFILTLNTENGEIRKQINKRLVPDFDFLNDDLVQLIIDNKDSFDIKTNNKWHRFSLKTMNKLIPTMIERPVEQMTLLTEMGLIKKDTKRFEGNKYLPYKEIANDIFNPVASKSVREALKIVNAVLKKYGHIEYIVIEMPRDKNLDEERKQIADFQKKNKKIKDAAFNAFVKAVGSKKNVKIALSKNRKLQMGIRLWHQQQGIDPYNGEEINANDLISNPDKFEIDHIIPQSISFDDGINNKTLCFASMNQVKGQKTPYEFLNEGHGQGYAKFKAIVSKNKNFSKAKRDNYLFEENVSNIETRKRFLSRNLVDTRYSSRVVLNSLQEFFHEKSDDTKVTVIRGKFTSNMRKHWHIDKTRDTFHHHAIDASIIAATPFLRMWKKGSTIFPTKINETSIDIETGEILDDKNFDKVMYEEPYSGFISEIMNADDRIKFSHQVDKKMNRKVSDATIYSTRIGKLSKDKKDAEYVVAKVKDIYSVDGYENFKKVYKKDKTKFLLYKYDPRTFSELEKIVIDYPDKIEKVQTNGKIKAVDISPFELYRRDNGMVRKYSKKTGPAIKQLKYLDKKLGSHIDITPKNANNKHVVLQSLKPWRTDVYLNHETGEYEIMGIKYSDLKFNKNEGYGIKKDKYLKIKNIEGVSENSEFMFSLYRKDRIKVQDMETNESVELLFWSRNFSNKKYAELKPISQIDNDKVLPIYGRGRLIKRLIPKNCKIWKVNTSILGDTYYLEKESNYPQKFLINHDGMVLFLLVRDALCVCAHIRLKFYCF

SEQ ID NO: 936 - protein, 1330 aa, Enterococcus pseudoavium
MAKEYTIGLDIGTNSVGWAVLDTNYDLIKKNMKIQGNGDKKKSKKNFWGVRLFEAGETAESTRMKRTTRRRYTRRRNRISYLQEIFQGEMDKVDENFFHRLEDSFLVPEEKRNECHPIFATLEEEVAYHEQFPTIYHLRKFLADSTELADIRLVYLALAHIIKFRGNFLIEGKLNTENSSVKETFKVFLQAYNQAFTVQENGSLINPVKETTDVSPVLQERVSRQRKAENALKLFPNEKSNGTFMQFLKLIVGNQGNFKKTFGLSEDAKLQFSKEEYEEELENLLGAVGDDYADVFAAAKNVYDAVELSGILTVKDIKTKAKLSASFIKRYEEHKTDLEKLKKFVRKELPEKYYEVFRDSTKNGYAGYIENSSKVSQAEFYKYLEKLLKNIPGSEYFFDKINQEDFLRKQRTFDNGVIPHQIHLEELRAILGKQGHYYPFLKENQEKIEQILTFRIPYYVGPLAQGNSRFSWLSKKTDAAIRPWTFTEVVDEGKSATAFIERMTNYDSYLPQEKVLPKHSLLYEKYMVFNELTKVSYLNDRGEIHNFSSVEKKEIFSELFKKNRKVTYALLEHFLKNQYMIETAEIRGIEQRFNASYGTYHDLIKLGISQEMLDDPVNEPMFEEIVKILTVFEDQKMIKEQLSKYADYFEPNVLKKIVRRHYTGWGRLSAELIDGIRDQQSKKTILDYLMRDDDLPVNKNRNLMQLINDENLSFKEIIQQRQSVDQTADLHEVVKELAGSPAIKKGILQSLKLVDEIVKIMGYPPTNIVVEMARENQTTSRGRDKSKARQKVLEEAMKEFGSNILKEYPLDNANLRNDRLFLYYLQNGKDMYTGKELDISKLSQYDIDHIIPQSFIKDNSIDNLVLTSSTENRGKSNDVPDEKIVSNMTNFWEKLKKANLISQRKFDNLTKGSLTDADKAHFIQRQLVETRQITKHVARILHQKYNAEAEDTTRIITLKAALTSQFRQIYQLYKVREINDYHHAQDAYLNGVVAQALLKVYPRLEPEFVYGDYQKFNLFKENKATAKKNFYSNLMHFFESTQPKVDENGEILWDQKNIAMVKKVMTYRQMNIVKKTEIQTGGFSKESILPKGDSAKLIARKKEWNPQKYGGFDSPNIAYSVVINHEKGKQRKLTKDIVGITIMERRRFEENEHQFLADKGYQNPRVLAKLPKYTLYELENGRRRLIASATEAQKGNQMVLPNQLVELLYHAKHCEDLDGKSLNYLNTHRDLFNELFEYVSQFADRYTLADKNLKTLASLYEQNQEADSKILAQACLNLLQFNKMGAPADFKFFDTTIPRKRYTSIKEILTATIIHQSITGLYETHWKLGE

SEQ ID NO: 937 - protein, 1133 aa, Enterococcus canis
MKQNKELVNIGFDIGIASVGWSVVSKQSGKILETGVSIFPSGTASKNEERRSFRQARRLLRRRKNRISDLKILLEENGFRIAKLNQLVTPYELRVRGLNEQLSKEELSVALLHLVKRRGISYSLEDSEGEGDNQTSYKQSVSINQKLLKEKTPGEIQLERLEKYGKIRGQVKDLQEENAAVLMNVFPNTAYVREAELILLKQKEYYSEITDNFIKEATALISRKREYFVGPGSEKSRTDYGIYRTDGTKLDNLFEILIGKDKIFPNEFRAAGNSYTAQLYNLLNDLNNLKIKTLEDGKLTKDQKLSIIEELKTTTKKVNMMQLIKKIAKAEESDISGYRIDRNDKPEIHSMAIFYKVRKKFLEQEIDINDWPIDFLDILGRVLTLNTENGEIRRSLTELKKDYIFLDETLIELIINSKDSFKLTSNQKWHRFSLKTMQLLIPELLNSSKEQMTILTELGLLHENKQDYSNKTKIDVKNLTENIYNPVVRKSVKQAMDIFNSLFKKYPNIAYLVVEMPRDEAEDEVEQKKQAQKFQKENEAEKEKSLKEFQELAGVSDSQLENQIYKRRKLRMKIRLWYQQLGKCPYSGKTIAAEDLFWTDHLFEIDHVIPLSISYDDGQNNKVLCYSEMNQEKGQKTPYGFMQSGKGQGFSALQAMLKSNSRMSGAKKRNLLFTEDINDIEVRKRFIARNLVDTRYASRIVLNELQQFTRSKQLDTKVTVIRGKFTSKLRETWRLNKSRETHHHHAVDATIIAVSPMLKLWERNAEIIPMKVNENVVDIKTGEILTDKVYQEEMYQLPYASLLEDIAVMENKIKFHHQVDKKMNRKVSDATIYATRSAKVGKDKEPQNYVLGKIKDIYDTKEYENFKKIYDKDKSKFLMQQLDPMTFEKLEKVLKEYPDFEEVQQDNGRVKRIPISPFELYRREKGPITKFAKRNNGPAIKSVKYYDSKMGSAIDITPQTAKNKKVVLQSLKPWRTDVYFNQETKEYEIMGIKYSDMQYLNGNYGITNERYKEIQREEGVADNSEFMMSLYRGDRIKVIDTNSDESVELLFGSRTIPTKKGYVELKPIEKTKFDSKEIVSFYGQVTPNGQFVKKFTRNGYRLLKVNTNILGNPYYISKEGINPRNILDTGFKG

SEQ ID NO: 938 - protein, 1141 aa, Globicatella sanguinis
MEENKIYSIGLDIGIASVGWAVLNTKVQNIDDLGVRLFSARNSDNNLERRTSRGMRRLNSRRKTRKNDAKRFLVEHGFYEDEKLMNECPYRLRVKGLDEKLSKAEIYKVILHILKKRGVSYLDDSVVEDAPSGQDYKGAVESNLKLTQELTPGQIQFNRLNEDGRIRTGVNFKGEYQLNVFPVKAYANELKRILECQKDYHEEINHEFIDFFIRKEGKPEEIGLVYRKRPYYHGPGNKHNNSEYGRWANYEEDGKPAENIFDKLIGRDLQGYLRAASVSITAQKYNLLNDLNNITIDRENPKITTEEKEQILDFIINRDSSRLSYKDIFKEIGLSMDKIRGYRIDRNGKPEFHTMGAFRRWKTVFAEYDIDINTIDDKTYNEIAKAVMLNTERDGILDTLNNSLPDMDKNILEIVLDNKDKLRRKDGNESWHSFSIKTMEILIPELINTSEEQNTILERLGIKKINRRQLQKEKTIPADVILDEIYNPTASKSVRQAIKVFNALVKKYGKENIANVVIEMPRDKNEKEEQDNIKLMNKNNEQRKKDSQAYFLEKSGWNIERFESELRRPAFAKKLYHYFEQDGKCAYSGKAIQPEMLLTNETEIDHIIPLSISLDDSLKNKVLVKAEANQEKGQRSPIQAFDEGANFGQSKEAFIAWVSQNKNFAGKGKVTKAKLLLEDRNIYDPEVRDEFIARNLNDTRYSSRIVLNAIQSFFYESRTKVKVINGNFTHTLRKKWGDNLEKTRETHYHHAVDAVLCAVSPYVKPTAYEYRETEEGRAEMVDLDTGEVMSYAEYKKLRNIDKKSYIPEWKNFREQLYPSSLYPRIKFSHQVDKKSNRKVSDATIYSTREKTSVTKNGKEKTEEYVIAKIKDIYTVDGYKEFEKNRDKLLMKELDSKTFEILCKIADTYPNYIEKQDASSKVKKVDISPFKLYCAENNILAIQKYSKRGNGPFIRSLKYYNKKIGNHINITKDNDGQKIEQTERGKKVILANLNPWRTDVYFDPKTQSYNLLGIKYNHLKYQKGEYGIPKEIYQELMEKEKIGKEQEFVFSLYRKDLIRIEQGDLFVEGLYHSRNEVSKNYFEIKPVEQNKWTKEELPVLGITSNQRVIKGIKPEMILKKYYVDVLGNKFEVKKEEGPQNIL

SEQ ID NO: 939 - protein, 1092 aa, Brevibacillus laterosporus
MAYTMGIDVGIASCGWAIVDLERQRIIDIGVRTFEKAENPKNGEALAVPRREARSSRRRLRRKKHRIERLKYMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRASLLVEIHTLFESQRQHHNFLASKDFELEYINIWSSQRPVATKDQIEKMIGTCTFLPKEKRAPKASWHFQYFMLLQTINHIRITNAQGTRPLNKEEIEQVVNMALTKSKVSYHDIRKVLDLSEEYQFVGLDYGKEDEKKKVESKETIIKLDDYHKLNKIFNEVELAKGETWEAVDYDTVAYALTFFKDDEDIRDYLQNKYKDSKNRLVKNVANKEYTNELIEKVSTLSFRKVGHLSLKALRKIIPFLEQGMTYDKACQAAGFNFQGISKKKRSVVLPVIDQISNPVVNRALTQTRKVINALIKKYGSPETIHIETARELSKRFDERKNITKDYKENRDKNERAKKHLSELGIINPTGLDIVKYKLWCEQQGRCMYSNQPISFERLRESGYTEVDHIIPYSRSMNDSYNNRVLVMTRENREKSNQTPYEYMGNDTQRWDEFEQRVTTNPQIKKEKRQNLLLKGFTNRRELEMLERNLNDTRHITKYLSHFISTNLEFSPSDKKKKVVNTSGRITSHLRSRWGLEKNREQNDLHHAMDAVVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNAKKAFSTDLHKPKKDGTKGPLIKSVRIMENKTLVHPVNKGKGVVYNSSIVRTDVFQRKEKYYLLPVYVTDVTKGKLPNKVIAAKKGYDDWIEVDDSFTFLYSLYPNDLIFIRQNPKKKISLKKRIESHSISDSKEVQEILTYYKGVDSSTAAIEFITHDGSYYAKGVGVQNLDCFEKYQVDILGNYSKVKGEKRLELETSDNNHKGKDVNSIKSTSR

SEQ ID NO: 940 - protein, 1086 aa, Pseudaminobacter salicylatoxidans
MPFRQPVSYAFDMGTNSIGWCVFRLNAAGHPVAIADAGVRIYSDGRDPQSKTSLAVARREAKAAARRRDRTKRRQKATLRTLAEYGLMPGGKDERERLLRETADSADRNAPANDPLNLRARALTEKLPLHHIGRALFHLGQRRGFKSNRKTDRRENDKGKIAIGIDRLRDAIREAKAETLGVFLASRRAQGLHVRLRAGSSVILDDGYDFYPVRSLLEEEFRHIWDAQAVHYPDVLTEARGEHLFKVIFYQRPLKKPRIGSCTFNPLEQRLAKAHPLFQAFRLYKEVNELEIVAPYLSQRKLTLDERDALMRRLRGAKTAKYKTLRKDLKLTPDMRFNKESENRVDMAGDEVTAALSAKGLFGPRWNTLAMDSQWKVIERIQEEENPFVLHQWLVETHGLSDDAAEAVAACHLPEGYGRLGHTALSIMLEELKADVIPEAKAAERAGYNHSYFGTGEIFDELPKYQEVVARSIPPGTGDLGDEYDVRKGRITNPTVHIGLNQLQRLVNGLIRRFGKPAEIAVELARDLKTNEKKKTEINRRIGENTRAARQRSEKIAELRKDTPALVDNGYNRLLLKLWEELNPAKPEDRCCIYTGKPISISMLFSGAVDVDHILPYSRTLDDGQGNKLLCLREANRVKRNRAPSEVTEWANHYDEILERANRLPKPKRWRFARDAMADFDADSGFLDRQLTDTQYLSRLAREYLCSLYPEKHEQWRVRVIPGRMTEMLRRNWGLNKLLPDHIYGDAKNRNDHRHHAIDAAVVGVTTRSMLQRISTEAARREEQELEDVVKGIPVPWEHFRDDLQQALDNIVVSHKPDHGTVGLDDKGKWQTAGKLHNDTAYGLTGEADARGNTIVVRRKMLLSLTDKDIPAIRDDELRARLYSAVGGLSGKELQQALLDFARKDPKYRGIRRVRVTEPLTVIPIRDKDGNVYKGYKGDANYRYDVWEMKDGKWQAEVISMFDAHQKGWESPVRKANPTARKVLSLQQNDMVAYEHPSDGYTIARVVKFASSGQIVFARNNEGGSLKARDANRDDPFKYFSKTTNGLREIKARQIRIDETGRVYDPGPRDRESRMISNQKLKTIAI

SEQ ID NO: 941 - protein, 1353 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGLYKKDAKRGLVPTSKRVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKISATERMRMYNNILKFISKDKKVDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVALLNFTMMGAATDFKFFGQIIPRKRYPSTTECLKSTLIHQSVTGLYETRIDLSKLGEN

SEQ ID NO: 942 - protein, 1126 aa, Streptococcus massiliensis
MNGLVLGLDIGVASVGVGILDKKTGEIKHANSRIFPAATADSNVERRGFRQARRLSRRKKHRGKRLLDLFEEYQLLTDFSNLSLNLNPYQLRVKGMREKLTNEELFIVLKNIVKHRGISYLDDAAEDDNNSSSEYGKAVEENRKLLEDKTPGQIQLERFEKYGQIRGDFTIIDENGENHRLINVFSTSAYKKEAERILRKQQELNAAITDEFIESYIKVLTGKRKYYHGPGSEKSPTDYGLYRKINGKTEKIADNLFGILIGKCSFYPEEYRAPKASYTAQEYNLLNDLNNLTVPTETKKLSEEQKHQIVEYAKTEKTLGAKKLLQYIAKLTNGTFDDIKGYRIDKSDKPDIHTFEVYRKMQTIETIDVAILPRETMDELAHILTLNTEREGIEEAIKKEFLNQFSEQQILELVQFRKKNSSLFAKGWHSFSIKLMKELIPELYTTSEEQMTILTRLGKQKAKETSKRTKYIDEKELTGEIYNPVAAKAVRQAIKIINLATKKYGIFDHIVIEMARDKNEEDEKKEIQKRQKANEDEKSAAMKKAATLYNGKVELPDSIFHGHKELATKIRLWYQQEERCLYTGKKIDIQNLIHNQHMYEIDHILPLSLSFDDSLANKVLVLATANQEKGQRTPFQAIDTMDDAWSFREMKAYVNGLKNFSKKKKEYLLTEEDISKIEVKQRFIERNLVDTRYASRVVLNSLQDFYRQNDFDTKISVVRGQFTSQLRRKWKIDKTRDTYHHHAVDALIIAASSQLRLWKKQGNPLISYKDGQFVDPETGEILSLTNDEYKELVFQPPYEHFVETLKSKKFENSILFSYQVDSKYNRKISDATIYATRQAQLGKDKSEETYVLGKIKDIYSQSGYDDFIKRYHKDKTQFLMYHKDPVTFEKVIEKILEVYPDKELNEKNKEVPCNPFDKYRKENGPIRKYSKKGKGPEIKSLKYYDNKLGNHIDITPNNSQNRVVLQSLKPWRTDVYFNGQTGKYELLGLKYADLQFKQGGGYGLSLEKYKEIKCREGVAEHSEFKFTLHKNDLILIKDTESGEQQLFRFLSRTMPNQKHYVELKPYDKAKFEGDQKLMKIFGSVAKGGQCLKGLNKSNLSIYKVKTDVLGDKHFIKKEGEQAKLDF

SEQ ID NO: 943 - protein, 1224 aa, Alistipes ihumii
MTKILGLDLGTASIGWALVERNDTEYALLDQGVDIFQEGVAREKNSEKPAVQDRTAARALRRHYARRRLRKIDLLRVLVRHDLCPALTDEQLKDWKQKKIYPLTDEFIRWQRTDDRTDKNPYRDRYKALTETLDLDTQRDRYTLGRALYHLAQRRGFLSNRKDAGDESESGKVRQSIEGLTADMEKAGCSYLGEYFYRLYARKEKIRTKYTSRNEHYLAEFRAICEKQRLADDLRKALHRAIFYQRPLKSQKGSVGRCTFEKDKSRCPASHPRFEEFRMLSFVNNIRITTPDDPEPRPLSRQEAETILPLFTRKTKPHFDFEEIAKKLAGKGRYACQGDRGEAPYRFNFARTATVTGCPVTASLIALFGDDYLTKICDLYTLGAGKTREQILGDVWHALFSFDDEERLSAWAKQKLRLSDDEAGRFAAIRLPQDYAALSLHAINKILPYLREGYRYDEAVFVANLKAVLPPDIYSDESERNAIEADIAALITDFRQNPLNRGTTKEQCVRDYLRNCRGIDEKRLGRLYHPSMIEIYQTAQPDAQGILQLGSPRTPAVRNPMAMRALFRLRVLVNRLLRDGKIDRETKIHIEFARGLNDANRRKAIELYQRDREAERKAYADEIRRQYASESGREIEPTDDDILKYRLWKEQNHICPYTGKRIGLSDFMGDSARFDIEHTVPRARGGDNSQMNKTLCENRFNRELKRDKLPSELPNHADVMARIDELGWPKEIASLQKQIEIQRRKSKSATTKSEKDGAIQRRHVLQMRLDYWRGKYERFTMTEVPDGFSNRQGVDIGIIGKYARLYLKTVFERIYTVKGTTTAEFRRMWGLQEEYARKERVNHTHHCLDAIVIACIGRNEYDRWAQYAGDEERYRRGEGAKPRFEKPWPTFTEDLEAVADRLLVAHHTPDNMPKQSRKRLRIRGRIRTGRNGETLYAQGDTARGALHQQTFYGAIERQGEVRYVVRKPLGQLQPSDVDNIVDDAVRQKVKEAIDAVGFKTAMDTESHPIWMNEQKRVPIRKVRIFVGKNISPKPLGGKKHRDLSALPHKRPVYVSYGSNYCMAIYEGKDNQGKLKRTFEIVSTLEAAQYFKASADKAARPDLVPQSDEKGFPLKCILKTGTMVLFYEETPEELYDCTQQELAKRLYKLTKFSSMTTGNNSYGLCTFRHHREARPAGELKPKGGAWKAGEAYRPLISLYHTQLNAYVEGFDFELSVTGTVRFKHE

SEQ ID NO: 944 - protein, 1192 aa, Streptococcus
MNGLVLGLDIGIASVGVGILEKNSGKIIHTNSRIFPAATADSNVVRRSSRQARRLNRRKKHRRVRFQDLFEDYGLLTDFSKVSINLNPYRLRVDGLNQQLTNEELFIALKNIVKRRGISYLDDASEDGGTVSSDYGKAVEENRKLLAEQTPGQIQLDRFERYGQIRGDFTVLENGEKCRLINVFSTSAYKKEAERILRKQQEFNSKITDEFIEDYLKILTGKRKYYHGPGNEKSRTDYGRFRKDGTTLDNIFGILIGKCTFYPNEYRASKASYTAQEFNLLNDLNNLSVPTETKKLSEEQKKTIIEYAKSAKTLGASTLLKYIAKMIDASVDQIHGYRVDVNNKPEMHTFEVYRKMQSLETISVGELSRNVLDELAHILTLNTEREGIEEAINTKLMGVFSQDQVLELVQFRKNNSSLFSKGWHNFSLKLMMELIPELYETSEEQMTILTRLGKQKNKETSKRTKYIDEKEVTEEIYNPVVAKSVRQAIKIINEATKKYGIFDNIVIEMARENNEEDAKKDYIKRQKANQDEKNAAMEKAAFQYNGKKELPDNIFHGHKELATKIRLWHQQGEKCLYTGKNIPISDLIHNQYKYEIDHILPLSLSFDDSLSNKVLVLATANQEKGQRTPFQALDSMDDAWFYREFKSYVKDSKLLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLISYKEGQFVDSETGEIISLSDDEYKELVFKAPYDHFVDTLRSKTFEDSILFSYQVDSKYNRKISDATIYATRKAKLDKDKSEETYVLGKIKDIYSQAGYDAFIKIYNKDKSKFLMYHKDPQTFEKVIEEILRTYPSKELNDKNKEIPCNPFEKYRQENGPIRKYSKKGNGPEIKSLKYYDKNIPESFINITPSNSNNKVLLRQLYPWRTDVYFNPQTDKYELLGLKYADLQFEKATGKYSITIDKYNEIKEKEGVSKESEFKFTLYKNDLLLIKDTKNNEEQIFRFLSRTMPNQNHYVELKPYDKGNFEGKEKIKVLKMTSNGRCIKGLGKKYLSIYKVKTDVLGNKHFIKKEGDEPKLFFLKYFKKRVANACTMYYNSNCKGRLAQLLKSCRSYKDKASCRIQHPVNYGWVFSFCERGKYDDLENCACLSE

SEQ ID NO: 945 - protein, 1148 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEAYPSMYHLRLRLMTDASQADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHNEDLELFKTYLKKLNDHELAKTIRVIYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAKSGENVFAWMVRKDPSGNITPYNFDEKVDREASANVFIQRMKTTDTYLIGEDVLPKQSLLYQKYEVLNELNNVRVNNEALGTDQKQRLIREVFERHSSVTIKQVADNLVAHGDFAQRPEIRGLADEKRFLSSLSTYHQLKEILHGAIDDSTKLHDIENIITWSTVFEDAAIFKTKLAEIDWLDAATIKKLSNIRYRGWGQFSRKLLDGLKLGNGQTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFTSTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYAKLAPFFTYGEFAKVDVKKFREFNFIGALKHAKKNIVAKDTGEIVWDKERDIQELDRIYNFKRMLITHEVYFETADLFKQTIYAAKDSKERGGSKQLIPKKRGYPTQVYGGIHGKIRLTWRWLKLLRRKKMSIELSELQLLK

SEQ ID NO: 946 - protein, 1057 aa, Virgibacillus senegalensis
MNKRFVLGLDIGIGSVGWGIIDQNQNILDAGVRLFPEADKSFNESRRSYRGTRRLLRRRRHRTDRVVFLLDEYQIWKKEKNIDYKKYKVTPYHLRMKGLREALTDEELAIALLHLAKRRGIHNLEVSDDEKTSNNELSTYDQVKKNKKLLEDKYVCEIQVERLNKEGQIRGHQNRFQTQDYVKEAKRLLETQSSHNPHITIDFIEKYKELLQNRREYYEGPGFGSEYGWDQDIKKWYENMMGRCSYFPDQLRAVKESHSAQLFNLLNDLNNLTVNREENIKLLPEEKQRIVDSLFMKNKSVSLKKIAKELGVNEHDIKRYRVDTKGRPLFTALTTYHDIKKATNKPAVLESVEAIDEIAETLTIYQSKKDIEQELKKSSLPLNEEEIDHLSNLSYSGTHSLSLKMINLILPDLWQTSKNQMQLITELGYKPKDIDYSNRKYIPYAQIEGYILSPVVKRSFKQTVRIINAIIKKYGVPDEIIIELAREKNSDDKKKFLKDLNKKNESINKQVRDKLEALDIDASKGVFNKLRLWHLQDGICMYSMQPIEIEDLISNPQNYEIDHIIPRSVSFDDSQSNKVLVHKAENQKKGNYTPFQYFHSNKTDVSYDKFKAHVLQLAKSSQKISRKKKEYLLEERDINKFTIQKDFINRNLVDTRYATREILSTLQQFFSENNQHVKVKSINGSFTHYLRKLWDFPKDRGADFKHHAEDALIIAMANHIFEYQSSFKAEHLIFANDDMIDSETGEILSESQFNAAFTEKITKVKSIKHYIDYKYSFKVDMKPNRQLMNDTLYSTRQKGDEEYVVNKLSGIYDKDSQDSVKLKKLMEKTPENLLMFHHDPQTFEKLKQVFEQYSESKNPLNQYYEEEGDYLRKYSKKGNGPVIKTIKYYGKRLSEHHDLSHKFQPKDKKVINLSIKSFRMDVYKDGDQFKFATVRYNNLKEKKDGYHIDEKAYHEELDEKNISPSAIFMFSLYKNDILQLNGELFRLIGINDNKHNKIELNTVSHDYKQYCEQHGIKNNRIIKGISKNTKDFYKITTDVLGNRYISTKEKWKDTFQK

SEQ ID NO: 947 - protein, 1056 aa, Mannheimia massilioguelmaensis
MSVRITNMFKPLNYILGLDLGIASVGWAVVEIDEQGNPLRLIDVGVRTFERAEVAKTGESLALARRLARSSRRSVKRRAVRIKKAKRLLKAENILLSVDEILPNDVWQFRVKGLDHKLERQEWAAVLLHLLKRRGYLSQRKNESKRENKELGALLSGVSTNHQILQSAEYRTPAEIAVHKFQAEDGHIRNQRGDYTHTFSRLDLLAEMELLFQRQTELGNQYTSSKLLENLTALLMWQKPALTGEAILKMLGKCTFEPTECKAAKNSYSAERFVWLTKLNNLRILEQGAERALTDSERFALLDQPYKKAKLTYAQVRTLLKLSDEAIFKGVRYQGEDKKTVENKTTLMEMKAYHQIRKALDGADLKDEWNRLKNDSALLDEIGMAFSLYKTDDDISHYLGGKLSEKVLNVLLENLNFDKFIQLSLKALQQILPLMLQGQRYDEAVSTVYGDHYGKKSAESCRLLPAIPANEIRNPVVLRTLTQARKVINAVVRLYGSPARIHIETGREVGKSYQDRKKLEKQQEENRKQRESAVKKFKEYFPNFVGEPKGKDILKMRLYELQQSKCLYSGKSFDPNRLLEKGYVEVDHALPFSRTWDDSFNNKVLVLANENQNKGNLTPYEWLDGKNNSKRWQDFVARVQTCCFSHWKKQHILSHKLDEKSFIERNLNDTRYVARFLCNFIADNMLLTGKGKRKVFASNGQITALLRGRWGLQKVRDDNDRHHALDAVVIACSTVAMQQKITRFVKYEEGNVFSGERIDRETGEIIPLHFPTPWKFFKENVEIRIFSENPKLELENRLPDYPQYNHEFVQPLFVSRMPTRKMTGQGHEVKLRSARKLDTTGKSIKKEFLTDLTLKNLDNMMNKEREPELYQSLVEHFKKYGDKPKEKFFKKGGTEVKSIRICKTQNKFVDLGNKTIADNGDIVRTDLFLKGKKYYFVNIYAWQVAEDILPRETTTGDLLDDSYIFQFSLFKNDVLEISHPEDENKSVFVYFIRPDDERRWILKFHDNAKIPNIYGKKDETSIRLSIQGQKFIRKYQVDELGKNIRPCRPTKRQNVR

SEQ ID NO: 948 - protein, 1382 aa, Streptococcus suis
MMKKSYAIGIDIGTNSVGHCVMYTENYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKDFIRQNLSDSYKEFFNDTLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLKRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLMGLDKDNKSFNASLGTYHDLKKIVSKDLLDNPENEDILENVVLTLTLFEDREMIRKRLEKYKDVLTEEQRKKLERRHYTGWGRLSAKLINGIRNKTTRKTILDYLIDDGTSNRNFMQLIHDDTLSFVDEIRLAQGSGEAEDYRTEVQNLAGSPAIKKGILQSLKIVDELIGVMGYNPEHVVVEMARENQFTNQGRRSSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDDAGNRIRDPKVNIITLKSSLVSQFRKDYQLYKVREINNYHHAHDAYLNAVVATALLKKYPQLAPEFVYGDYPKYNSYKSRKSATERVLFYSNIMNFFKRVVKSSKTGTVKIRPIIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFEKNPKQYLLNLGYKDIKSIIKLPKYSLFELENGSRRMLASILSTNNKRGEIHKGNEMYLPDKFVTLLYHAMRVNRTLEPGHKKYVETHRHVFDELLTYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 949 - protein, 1367 aa, Streptococcus suis
MVKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 950 - protein, 1358 aa, Lactobacillus plantarum
MKEPYGVGLDIGTNSVGWTVVDASGHVRKIKGQTGIGVRLFKEGAAAADRRGFRTTRRRLKRVKWRLRLLREFFDQPISKVDINFFARRKYSDISPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRIKQNGAIPYQVQQNELDQIISNQKEYYPWLGEENPVIKRRGKFPYKLDELVGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAGEFPTAPRITGLADPKVFNSSLSTYHDLKQVLPEAMSDVRKQADIEKIILWSTIFEDSTIFKQKLTEISWLTAAQLKQLGQLRYRGWGQLSRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVSDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKTDFGKLQVPGGIKLTGDAEIIYQSPTGLFERKISLKDL

SEQ ID NO: 951 - protein, 1448 aa, Bacteroidales bacterium CF
MKRVLGLDLGTNSIGWALIEQDCDAKQSNILGMGSRIIPMSQDILGEFGKGNSVSQTSERTAYRSTRRLRERFLLRRERLHRVLNILDFLPTHYASQIDFKKRLGKFKENKEPKIAYDNKSFLFLDSFNEMLKDFEQEQPNMLINEKGEKKLIPYDWTLYYLRKKALREKISKEELSWIILNFNQKRGYYQLRGEDEEENPSKLVEFHSLTVVDVVPDEPIKGKLETWYSIILDNGWVYRRSSKTELYDWKDKIKEFIVTTDLNYDGTVKTDKEGNVKRSFRAPSETDWTLIKKKTEYEIEQSSKTIGEYIYNTLLKYPEQKIRGKLIRTIERKYYKEELKQILLKQTEFHNELKDDSLYYDCLRELYRNNESHQLFLEKKNFAQLFIEDIIFYQRPLRSQKSLISNCPLEFYKFKDSVGNEKVQHLKAIPKSNPFYQEFRIWQWISNLSIYSKLDDSNFTSHFFDSTDDWESLFEMLNGRKEIEQKQLLKFLLEKKGFKGKSLSSEIEKYRWNYVEDKKYPCNETRSLIQSRLDKVANLPESFLTRHVEQELWHLIYSVTDKIEFEKALDTFSKKYKIDTPTFVDAFKKCPPFKSEYGSFSEKAIKKLLPLMRTGKYWDLDNIDKATKQRIEKIISGEYDKDIRDRVREKAINLLSETDFNRLQLWLAQYIVYDRHSEATSLDKWETIDDIVTYLHSFKQHSLRNPIVEQVITETIRVVKDIWSNYGNGSKDYFNEIHVELGREMKLPAEERKRIQEKNSQNEDTNLRIKALLSEMQNDPNVENVRPYSPVQQEILKIYEEGVLNSNIEIADDILKISKTAQPSSSDLKRYKLWLEQKYQSPYTGEIIPLNKLFTPEYEIEHIIPQSRYFDDSYNNKVICESAVNKLKDNSLGYEFIKGYNGQIVECGFGKKVKIFSIDEYEDFVQKNYANNRSKASRLMMADIPEKMIERQLNDTRYISKYISNILSNIVRSESNDDGVNSKNLISVNGKITTVLKKDWGMNDIWNDLILPRFIRMNQITDSDSFTTWNERFQKFIPTVPIELSKNFSAKRIDHRHHAMDALVIACATRDHVNLLNNLYAKSSARYDLNRKLRIFEKTTYKDIKTGQIIEREIPKAFLKPWQNFTTDAKDAIESIIVSYKQSLRVINKSTNYYQKWVEKDGIVKKEKIKQEGKNWAIRKPLHKDTVSGLVQLSWVKVPKGKVMTATRKSLDSSFDLKTIATITDTGIQKILIKYLESKGNNPESAFSPEGIEDFNNNIHLYNDGKKHRPITKVRLYEIGSKFPLGEKGNKNAKYVEAAKGTNLFFAVYANNKGERSFETIPLNLVIDRLKLGLSAVPETNEKGDNLLFHLSPNDLVYVPSEDEMENLKLINLEHISKDQLNRIYKMVSSTSNRCFFIKSEIALSIVNKIEYSPLNKMEKSIEGIMIKDVCLKLQVNRIGNLERYFS

SEQ ID NO: 952 - protein, 1100 aa, Corynebacterium lactis
MTTRYVVGIDVGLFSVGFSAIEVDEKGMPVRLLNSMSLIHDSGLDPNSQKEAKTRKAVSGVARRTRRLYAARRKRLAALDTFLTQHDFPLIDLEKEADKIAWSARATLATEKVEDHEQMKKLLSIAVRHIARHRGWRNPYIPAERLCTQRKASDKFTILEQKAREAARKPIPSTPTLAQLVGALPHGATQLRGENGFLSETLNQQDFANELLKIASVQDLEPQFVHELLLKVFYAKSPKGSAEKFVGKDELDPSQPRAWRATLAFNEYRIISLLANVRIADPSSPTFAQRRLTVNERQKAFNFLNNWTQKTSPTWTDIAELFGIDRGLLKGTASANDDGERMSATPPINQTHQIMWNCQVKSLREFWRKGSTAMRSALISELSNVEAPEEGSPESIAAATAIRSLPPEEMEKLETVKLPHGRAAYSVKTLDKIAKYILNNEADLHEARQEIFGVDAHWKPAAAPIAEPTGNPAVDRTLSAINRWILLAEKRWGTPLSVNIETARDGFKSASVAREIERGNSKRATRNLETRQAIAEKLGIEGRVRSSDMLRYQAIQRQNGQCAYCGTTITFKSAEMDHIVPRAGAGSTNRRNNLLAACHRCNLSKGKLPFAVWANSEKSGPSVSLEGAIDRVNQWPTDSGLSTREMRDFQQSVIKNLKRTSSDDKIDARSIESVAWMAIELRHRMISHFAKQGRSTPKIRVFSGTVTASARKAAGIEKQITMLGGGHGKNRLDRRHHAIDAAVVALMNYTTAQTILERENLRRAENIIQKPDTDFGTWKEYKGRNQQDRYLFEQWNLRMKSAVPMLQEALDQHRIAVTQNLRLRLGNGQAHEAGIGKLDSAKVGDALPVALIDRAASPALWCALTRLPDFDWKDGLPENPTRSIVVNGTHLNSEDKIEFFGVKAGAIAVRGGYAELGASFHHARLYRVPVGKRHAYCMMRVYTVDLVRHQHEDLFTVDLPPQTISVRQCEAKLRKALREGTAEYITWFVVGDELHFDASKVATGQAETFLAEFGDIRSWTVKGFYSDARLRLKPAVLSAEGITDEMDTDCKKVIDSPGWLPAVNKIFGLGGVTIVRRDAHGRPRLSARGNLPVSIQIDSL

SEQ ID NO: 953 - protein, 1055 aa, Staphylococcus agnetis
MNNYILGLDIGITSVGYGIVDSDTREIKDAGVRLFPEANVDNNEGRRSKRGARRLKRRRIHRLDRVKHLLAEYNLLDLTNIPKSTNPYQIRVKGLNEKLSKDELVIALLHIAKRRGIHNVNVMMDDNDSGNELSTKDQLKKNAKALSDKYVCELQLERFEQDYKVRGEKNRFKTEDFVREARKLLETQSKFFEIDQTFIMRYIDLVETRREYFEGPGKGSPFGWEGNIKKWFEQMMGHCTYFPEELRSVKYAYSAELFNALNDLNNLVITRDEEAKLNYGEKFQIIENVFKQKKTPNLKQIAKEIGVSETDIKGYRVNKSGKPEFTQFKLYHDLKNIFEDSKYLNDVQLMDNIAEIITIYQDPESIIKELNLLPELLSEKEKEKISALSGYAGTHRLSLKCINLLLDDLWESSLNQMELFTKLNLKPKKIDLSQQHKIPIKLVDDFILSPVVKRAFIQSIQVVNAIIDKYGLPEDIIIELARENNSDDRRKFLNQLQKQNAETRKQVEKVLREYGNDNAKRIVQKIKLHNMQEGKCLYSLKDIPLEDLLKNPNHYEVDHIIPRSVAFDNSMHNKVLVRAEENSKKGNRTPYQYLNSSESSLSYNEFKQHILNLSKTKDRITKKKREYLLEERDINKYDVQKEFINRNLVDTRYATRELTSLLKAYFSANNLDVKVKTINGSFTNYLRKVWKFDKDRNKGYKHHAEDALIIANADFLFKHNKKLRNINKVLDAPSKEIDKKRVTVQSEDEYNQMFEDTQKAQAIKKFEIRKFSHRVDKKPNRQLIKDTLYSTRNIDGIEYVVESIKDIYSVNNDKVKTKFKKDPHRLLMYRNDPQTFEKFEKVFKQYESEKNPFAKYYEETGEKIRKFSKTGQGPYINKIKYLRERLGRHCDVTNKYINSRNKIVQLKIYSYRFDIYQYGNNYKMITISYIDLEQKSNYYYISREKYEQKKKDKQIDDSYKFIGSFYKNDIINYNGEMYRVIGVNDSEKNKIQLDMIDISIKDYMELNNIKKTGVIYKTIGKSTTHIEKYTTDILGNLYKAAPPKKPQLIFKRGME

SEQ ID NO: 954 - protein, 1350 aa, Enterococcus cecorum
MNKYYLGLDMGSASVGWAVTDENYHLVRRKGKDLWGVRTFDVAQTAKERRVTRGNRRRQDRRKQRIQILQELLGEEVLKTDPGFFHRMKESRYVVEDKRTLDGKQVELPYALFVDKDYTDKEYYKQFPTINHLIVYLMTTSDTPDIRLVYLALHYYMKNRGNFLHSGDINNVKDINDILEQLDNVLETFLDGWNLKLKSHVEDIKSIYNRDLGRGERKKAFVNALGAKTKAEKAFCSLISGGSTNLAELFDDSSLKEIETPKIEFASSSLEDKIDGIQESLEDRFAVIEAAKRLYDWKTLTAILGDSSSLAEARVNSYQMHHEQLIELKFLVKEYLDRKVFQEIFVSPNVANNYPAYIGHTKINGKKKELEVKRTKRNDFYSYVKKQVIEPIKKKVSDEAVLTKLSEIESLIEVDKYLPLQVNSDNGVIPYQVKLNELTRIFDNLENRIPVLKEIRDKIIKTFKFRIPYYVGSLNGVVKNGKRTNWMVRKEEGKIYPWNFEDKVDLEASAEQFIRRMTNKCTYLVNEDVLPKYSLLYSKYLVLSELNNLRLDGRPLDVKIKQDIYENIFKKNRKVTLKKIKKYLLKEGIITDDDELSGLADDVKSSLTAYHDFKEKLGHLDLSEAQMENIILNITLFGDDKKLLKKRLAALYPFIDDKSLNRIATLNYRDWGRLSERFLSGITSVDQETGELRTIIQCMYETQANLMQLLAEPYHFVEAIEKENPKVDLESISYRIVNDLYVSPAVKRQIWQTLLVIKDIKQVMKHDPERIFIEMAREKQESKKTKSRKQVLSEVYKKAKGYEHLFEKLNSLTEEQLRSKKIYLYFTQLGKCMYSGEPIDFENLVSANSNYDIDHIYPQSKTMDDSFNNIVLVKKSLNAYKSNHYPIDKNIRDNEKVKTLWNTLVSKGLITKEKYERLIRSTPFSDEELAGFIARQLVETRQSTKAVAEILSNWFPESEIVYSKAKNVSNFRQDFEILKVRELNDCHHAHDAYLNIVVGNAYHTKFTNSPYRFIKNKANQEYNLRKLLQKVNKIESNGVVAWVGQSENNPGTIATVKKVIRRNTVLISRMVKEVDGQLFDLTLMKKGKGQVPIKSSDERLTDISKYGGYNKATGAYFAFVKYLRGKKIIKSFEYVPVYLAKKIDNDSKLLQEYLTTEKGLKDVKILVPKILINSLFKYNGSLIRIPGRYDKKSLVVNIDSPLLLDSTYISQLKVIESYMYKKRNAKSKDTEILLTKYALEQLQDLDSLFDVIAYKLNESIYCVVDDKYGKLMKCRDNFISLDKETKCEMIYELLRLFQCNSQLANLTKIGATSKFGSIIISKNLKDTDKMSIIHQSPSGIFEHEIELTSL

SEQ ID NO: 955 - protein, 1010 aa, Kiritimatiella glycovorans
MSDSSYVLGLDLGTNSIGWACVRLNKGKPDGLLAQGVRIFEAGLEIDAYGRGTPLNTERRNARQRRRLHDRRKRRILKVRRILQEAGMLPANKPDHKDAEWKMLLARNPYRLRAKALDEQIDLKEIGLCIYQFAHRRGFLSNSKILKKDDDRGKLKDATKAFAEDMEQKGARTWGEYLSHLDPHEQRIRTNYTLREWYTSEFDLIWEKQQSFYPHVLTDDLYKRVKEALFYQRPLKSQAHLLGQCELEPGRKRAPFALLMAQEFRLLQSLNHLRVVSSTGDERLLTDEERKQALALLRSRGNQKFTTLRKVLNLRGTKFNLERGGEKTIQGNNTAAALGNLFGEAWDHFSSEQKNQIVEDRLTIGDTDALIRRMKKTWGLDSVTAEMFSETELEDGYCGFSRKALEKLLPLLERGHALMEAVQAAYPDYQKNLPRTDTLPPLENLRNPIVQRTLSELRRVVNAIIKEYGKSDKIRIELARDMKQTAKNREKSWDRMRVRERQRKEAAKKILEETGNPAPRRHEIEKVLLAEECNWECPYTGKRICMNTLLGDAPQFDIEHIIPFSRSFDNSFSNKTLCDVNYNRNVKGNKTPYESASETEHEEMVCRVKRFTGDYKEIKLDRFNTRETDSRADFIEEFSTSQLNDTRYASRLAGEYLGKLYGSEWRKHIQIAKGGTTKYLRDAWDLNRILSDGGTKSRDDHRHHAVDAVVVALTTPQTVKALSDANQRAPEHRRYAFSDMPLPWETFRQDVEQAINSITVSHKVCRKANGQLHKETFYGLIKDRKTGDTRTVLRKPLHELTDKEIKRAEIVDSSIRKLIEQKLKDLDQPPKTAFKDRNNHPFIIDKNGNKRFIHKVRVYQDAKPVKIAENRHVKLGGNHHLEIFEVIDKKGNPTWKCEVISLFDTRQRVKEKRPVIVRQDQNGNPLKFSLSIGEAVQLDWNGGRETAVVQKMSKTPNTVEYVFRKHNDARKAADIPYKETITVKSDSALFASNLQKIVITPTGLIRRAND

SEQ ID NO: 956 - protein, 1138 aa, Actinomyces meyeri
MSASSENIRGIRYRVGIDVGLRSIGFCAVEVDQRDQPVRLLNSMVFIHDAGVDPNENKAAKSRKLTAGVARRTRRLYLTRRQRLSNLDRVLAKEFGWPILDLSRFKDPLEPWHVRARLLEGYVADDEERQKALSIALRHIARHRGWRNPYANVRTLLQPTEPSDFLMGLNERISTALGRNFAADTAPGQLVDAYLAHPDYAAKAGTPKLRGPKGILAGKLHQSDNAAEIRRICDIQKISPDDRDRLICAVFEAKSPKGSAKERGLVGYDELPGQSGHVRAEKAHPAFQKFRIVSVLANLRIREGRVERPLTPDELQGLTDYLMVAGLKQEITWQDLADNLGIERADLRGTAKASFDNSPVLRRPPTDVTTEKIMACKVKWLKEWWKEADEEQRGYVVDAFSNSGGSEDTTDVNDEAAELFERASEQDQLEFEKIALPQGRAAYSLDSLRRLTERMLTEGVDLHTARCLEFPGGNDWRPPVEEIGAPTGNPAVDRVLKQVSRWLHAATDRWGEPTVINIEHARDGLGSERVARELMRANERRRKANAAAVAEMTAQLGISGKTRRSDNIRYFALQRQDCQCLYCGTMITYETAEMDHIVPRADGSSTNDRSNLAAVCRTCNHKKGAIPFAVWASSEDTNEGVSLKGALERVRMWKQESGMSSKQLKQLKREVSARLKSTKLDEEFDGRSMESVAWMAVELRTRIEGHYRKRNESTVPSVGVYRGQLTAEARKASGFENRVNLIGGRGKTRFDRRHHAMDALVIALMNPSVSRTLALRLNMRDAQRLTGREETWKNFCGKPGEATQRFEAWRESMLRAVELFNIMLSENAIPFVENIRLRVGSSVVHDATVHSFCPSRTPEGEQIPTKVCGEQYPLGSALPVELIDRAETPALWTALTRCPDFDPQKGLPEDPHRVISVNGTRVAPTDLLNFFGSSAACLKVRGGYAELGSAIHHARIYRIDGKKATYAMVRVFQVDLLRLKSQDLFTTPLKPSTISMRTAEPKIRKALAEGTATQIGWLVEGDELRIDTSKYTGGFVGDVLARYPETTSWRVAGFKTPSRLRIKPLCLSKEGFVDEKQAARLGVEATTEAIIKTVDTPGWLPAVNVLFGAGGVYVVRRNCLGEERHRPSSSLPVTTILE

SEQ ID NO: 957 - protein, 1056 aa, Ottowia sp. oral taxon 894
MPKQKSTRYRLALDLGSTSLGWAVLRLNEQHEPNAIIRAGVRIFSNGRNPKDGSSLAVTRRAARAMRRRRDRLLKRKARMMNKLVEYGFFPADVAERKKLERINPYELRAKGLDAPLTPGEFARALFHINQRRGFKSNRKTDKKENDSGALKAAISHLRQQLHERKARTVGEWLWQRLQAGLGTRARYRESRVAQANGKTRIEKSYDLYVDRQMIAEEFDALWAAQAAFNPQQFSEQARGELRDVLLFQRDLRPVRPGRCTLLPDEERAPLALPSVQRFRILQEANHLRLLHPDLREEPLSLAQRDAVVDALEHNSKRTFEQLRKLLKLNGTVKFNLEDEKRKELKGNATSATLSKDGLFGENWWNLDEALQDAIVWQLVSEQSEEKLQNWLQANTGVNATQAETIANAGLPEGYGSLSYKALARIIPALRGTEVANGIDVPRTYDQAVQAAGFAHHSDLDSGFDFEHSHDEVERIGERVIASTGEVKPVFAFKQLPYYGKALRRHVAFAKEHPRNEEERYGKIANPTVHIGLNQLRVVVNALIRRYGRPTEVVVELARDLKQSREQRQEEQKRQADYQKRNEHIRREIASMHGCAEERVSHADVQKWILWEELSFDVADRRCPYSGVQISAQMLLSNQVEIEHILPFSQTLDNSLNNRTVAMRQANRIKGNRTPWQAREDFERQGWSYDSILQRAERMPKAKRYRFSRDGYERWLKEDKDFLARALNDTRYLSRVAKTYMELVCPLGTRVIPGQMTALLRAKFGLNDVLGLNGEKNRDDHRHHAVDACVIGVTDQGLLQRFAQASADARGNGLEKLVENMPVPWATYRDHVKRAIQCIWVSHKPDHGYEGPMMEETAYGIRKDGSIRQKTKADGSTGREITHLIRITEPTQNLRHGVDAQGQPLAYKGYVGGSNDCIEITQNEQGKWEGNVITTFQAYDIVRRLGSKQGPRRLRHPTLAQTLDVYGKPKKLVMRLMIDDCVRLELDGNKKTLRVVKITGNGQVFMAPVHEANVDKRNSDKTDPFAYVSKYAGSFQKAKARRITISPIGELHDPGF

SEQ ID NO: 958 - protein, 1070 aa, Spiroplasma turonicum
MKKVNIGLDIGIASVGWSIFDINNKKILKSGSRLFNEANAGTNKSSTTADRRMQRGRRRNLRRKILRKRDLLVLFKKYNFIKNEIDFYNLDFNHNFLELRTKALKEKITIDQLMVILFNYIKKRGSFNFKDDLLERKNIKMDNLSLDQINVQENILPLEIQQKNYLDHGKYRGLKTEDSLIAHEWYKNELIKILDIQISNNLISESFKEDYLNLFDRKRLYFEGPGFTTSSRIEKSKYGWKDEEEFYSRLSGYDTYDSSEKRAPKHSMTSYLFNILNDLNNLKIEKFNDGLSYEQKYKIIDSVINHDGNKNKNITLKHIAKLIDVEESSIKGYRIDKDSKPNFTKFEFINNLRTVLINSKLDYSFINLNNVKLLDEIANILTTFQTADSRKAKLLSINSFDLNEDQAEAISLISLSGTHSLSYKTMNIAIEEMWYENKNHMQIFSEKNIKPDYNIKINRRFNSMPLLKRKISDMYISPVVKRSLIESIKIIKEIEKMDEYEIKDIVIELARESNSEDLRKHITEIQKKNEKENNEIINKHNISTVRKDFKTKLKLALFNEQDGKCAYSNKEILLDRLLNDPNYCEIDHIIPFSVSLDDSRANKVLVLWSENQQKGKKTPYKYFREINRDWLTFKTLAYNHYIKNKNFGKYGHKKYENLVFEDDIDNDEVKQSFINRNLNDTRYATLEVKNYLTYFKKELNKSYSIKTINGSFTHYIRNNYLHLPKKDRDDFKHHAIDATVCAIAPLIDIIEGKTINSLSNEELSQDQIIKKEELNNLIKDILTFDYKITKKVEKKSNTMLFNDTIYTCKNINNQLYKVEKIDLLTLDNAKLKTLKSLFTTDMHKLSIYESDKKTYEYLKKVFDAYVNDVDIDNKPVKNPFYHFVYELKEKLVKQSNETNPPNIRYLKYIGKKVEKYTSITHKFKNVKRNKEIVMTGSNTLGWDLFYSEKYNLYKILPITHEVARFKTNDYSSDVEYKIKDYEIMKEKLNIDNTYIKKYTLNKNNELIFNYDNNLFHLIVIGYARNTERLEFKYLDKKTSSEKRITYAVKKMKNIKLITTNSTRTKIKVID

SEQ ID NO: 959 - protein, 1141 aa, Lawsonella clevelandensis
MRTTLDPIPTLPVEGSYVVGIDAGQNSVGLFALALTAEGVPHEILAMQSVIHDGGLDPDKAKSNQTRKASAGFARRARRRLRVEKKRLNKLDKLLDAQGWHGRQEAEFPTQIWEDRYRATSSYIEDDEERAQVLGEVFRHIARHRGWRNPYQPLADLFDDESQSDAFTRLVSNAQRVGARVDDSDTVGAIVWSALQCPHPVGLDPEDEARWANSNQLRIRTLGTESKKRPGLIDGRLFQVDNVHEIQRICATQNIPAELEEQLLGTIFDQNKASAGVMQTVGRCGLQPQLLRCSKAHPEFQRYRIAATLATLKIKEGHSARFLTAEERQKVAAELHNPHTTIATWGDVADLLGIEAPQLTGIASTTPDAELIVAARPPVDTTAIKMATKAKPFLKKWWNDAAPEQQQDFIELQVNYDTDSPDVNNYLLTLTPTELAEIETFSTKELPKGRASFAAETCRILADHLLNSDDSLADAIEMNFHRKPTVAQLTESTGIASVDRSLKIVSRFLQMARNYWGEPQAITVELAREGLMSAKAKADMEFQQRRARKARQTLQEKRGIREDNRRDTLRAEALHRQNNRCLYCGAPIDMHSVEMDHIVPRSGPGATNRVTNLAGSCHRCNQAKGGRTYAEWVKQDHPTYTNRKMVDDFVNHSMNLENQALPKKSMQKEYLRALHTVGKEDALDSRSLAPTATMGTILRGRLEAEFPETKVNVLAGFITAEARHAAGYWGLPTLHIEGDPHDNNKRIDRRHHAIDAAIMSITRPYTAQVLAQRKALRDQEKTLGSSYRSATVSNFYGSWKDFQGTDIAHKTAYQRWLSNSQVLIGLVAEKLLNDDIPVWTPLRLSRTSGRAHEDEIRPLAHRPVKAALTAKEIDASATEAQWCALTRCEDYDENTGLPENPERRIVINGTHLGPNDDLEFFTPKDNKKPDAICDQAALKVRDGWAAAGDFHHLRLYRIPQKKGFAYYFMRVLPFDLPTEGDLFSYELPPQSISIRQAHPKLKAALKKGEAVYLTWLVKNDVLEVDDKALGGIGKTLEEVIPNATRRWRVIGFDNSTTTIKLAPVLTSPEGVMSKQGGSSVDSRFDEATSRKLKQTVLAPNGWRPSAQVLMRGPLRVIRYDALGRERLSARSPLPFTLIIEP

SEQ ID NO: 960 - protein, 1096 aa, Pannonibacter phragmitetus
MKNIFSFDIGTNSIGWAVLALDGNGDPVRIADAGVRIFSDGRDPKSKASLAEARRMARAMSRRRDRTLRRKRATLRTLAEIGLMPDTSSARQAQLRETSDPKSGSGQLTRNPYALRALALEEKLPLFHIGRALYHLGQRRGFQSNRKTDRKDNDKGKIALGIEELHAAMRQDGAQTYGQWLARRHALGQAVRLRSGALDLEGEGYAFYPERKLLEDEFHRIWEAQARHYPDILTPERRDHLFTVMFFQRPLKKPKVGKCSFNNQEERLSKAHPLFQEFRLYKEVNELEIVEPDLTHKKLTLDQRNALVKKLQVSREASFAALRKVLKLRPDQRLNKESESRTKLKGNEVYAVLSDKTRFGPRWGTFSQAEQWAIIERLKEEEDPGRLFAWLRSAFGIEGEQAADIANVHLPEGHGRLGKTALEAMLEELKAEVITEAEAAKRCGYDHARLGGGSDEGEPELPPYQEILQHRIPPGTNNPDDPYDIEKGRFTNPTVHIALNQLRHVMNTLIRRYGKPAQIAVELARDLKLSERQKEEVNRTIARNTRDAERRGKTLEENRIPNTGYNRTLLRLWEELNPGKVEDRCCIYTGKPISISMLFSGEVDIDHILPWSRTLDDSHGNKLLCLREANRVKRNRAPADVTEWRDNYDEILSRAARLPQNKRDRFAPDAMERFEKAGGFLARQLTDTQYLSRMALEYLACLFPAEEMDGFGELRRHRYINVCPGRLTEMLRRNWGLNSILSDSQLGETAQEKNRKDHRHHAIDAIVIGVTGRSLLNRISYAAGRLEAQQLETLVKEAAATNKPWDGFREDVAKVVGGIIVSHKPDHGTAGRKAKDPARQQTAGRLHNDTAYGLTGETDARGNTIVVRRKPFLSLTSKDIPSIRDEALRAVLEQHLRGIPDGKAFQAALDAFRKQKGFHHYHGIRHVRLTEPLSVIGIKDRDGKVYKGYKGDANQRYDVWETLDGKWHAEVVSMFDAHQPGWQSRFHAENPTARRVLRLQQDDMVALNAPDGGRLLVRVVKFRQNGQITFAGHNESGNLKARDAASNEQDPFKYISRMASSLKDCGCRQVRIDATGQVFDPGPQDRASRLQKQSKR

SEQ ID NO: 961 - protein, 1524 aa, Salinivirga cyanobacteriivorans
MTRILGLDMGTNSIGWAVVDKEQEQIEDSGVRIFPEGVVNKNEGEGREKSKNALRTENRQIRRQVARRRFRKIKLLELLIEQDMCPLTKDQLMVWKHWDKSKKSEGRHFPQNERFSEWLTLNPYDLRNRGVNGELTKMELGRLLYHMIQRRGFLSSRKEKDTGKIYTGKENMVGIDDTKEALNSNTLGEYLYSIYPEDNESFQNMRDKKGDDLRIRGRYTLRDMYVEEFEKIWNQQAKRLGLDKVNVTKKKIVFLNGGKTRNRNAKKIEYLKKHRDKVDIDEIIIRRENANKKLTRVTSYKNISLHDHLGGRIELQDDKVKFDNKDSVLFYQRPLRSQKKLLGKCRYEKNKTPVSISHPDFEIYRAWLYVNTIKFGNNIPLPLEQKQKIIGYLKTKKSAVKFADIIKLLQMSHENFNYKDDDKVEGCPTIAQLSKLFSGSGWTQNYHNIWHDFYFYDDSELLFKKLSNAKAYELKDKITLDDIKKISIKDDAYARISLKAVRNILPFLKRGLLYNQAVVLGGVKNAFNYKVQSDEVPRWDRFEDDHDTIVKDILSIINQKNKQGETIERIKEYLTNPINEYGFEQNSPALKKLYHHSQEIEEKEKSDKISEIENLRNPIVQRAVQEMRRMVNELLKKHGKFDRIVVEMGREMKLGKKGRNELSRAIRQNFEANENVREILKEYQLAPSRQNIQKVLLFNEIQDKTGKVICPYTGKALNISDLLGVGNKVQIEHIIPRSYSQDDSFANKTLCDAKFNQLKGNLTPYQFYLKNSDKKLWGAASWDEIEQRAYNILHFNKAKRFTTKKLEWKTEEFISRQLNDDRYISRKTKEVLSEVCNEILVMPGAVTADLRRLWGLNNILQPTIGLPKDNFDIDENKSLSYWAVTDENKNIRKLYPTNNPRPDVAEGETVVAGNVTKNKFKSQRLNLEFDAPEIPDGKYYVKFPVSNPVETIRQYIEKPEYADNEVILRGLINRNKFKHDSLKQRVDVNENLEDGKYWAKFKIIDKGFEIPEKNKRPENKNGICLFGKVKDNHFTSYIYQCETDLKDGQYWVLLDLDFDNVEFIPTKNKKPEIRENQILVLGDVNEEKKFTAIHDMQLQFDWDEKPGRYWAVLNILSAEPEFTAIENKPPEIDDNEKLIEGKVWVDHKTGEIRFDPKKNRDDHRHHAIDAITIALTDYNIINQLNRYNAEKDTLQKGNAAEKPSFDEPWDGFFKQAKQIAGNILVSYHKDNTVTKKVKMFIEKNGKKFLSEGQAVRGELHKKYIYGKRKPPMGEQSFHKRKFLKDLKDNQLDKIVDENVKRIVKHAREREKILKAQITALQKDRTKAGDIEEKNIDEQIKSLEEEIRLLYTLPNKNGDRVPIKKVRIRENLGNTEMLKPSENVNQYVNPRNNHHVLIYRDNEGKLRESVVTLWEAVERKSQKEDVYQLPPDGKEKVTTLEVNDMFLLGLDSEQANNLLTIDKKILSKYLYRVQKVSGGDYSFRFHLASTLNKKEEEIRIASFTAWEKVHPIKIKINILGQIEKI

SEQ ID NO: 962 - protein, 1441 aa, Salinivirga cyanobacteriivorans
MKVLGIDMGSNSIGLSVRNPELGNDLENQLEYFSSVIFSSGVGNGKTGEYSYAAERTKYRSSRRLYQSRKYRKWETLKVLRYNKLCPLSESGLAQWSIYNKAKGLYRKYPVNEQQFEQWIKLDFNGDGKPDYASPYQLRDELMNRQLDMKNAIDRYKLGRALYHIAQRRGFKSSKGETIKEQENLENNSIESKPDKDIIRELKKSEDNKSKELTTYMKENNLKTVGQAFALLERNGIRIRGGKYQAIRSQYKEEVYEIFKFQQALSTDSDLFDRIISERKEKGSIFYKKPLRSQKGLVGLCTMERKIFFDKRNNQKIEKGKPRCPISHPDFEEFRAWSLINNIRYRRNAEEEWQSLALEDKHDLFNEKFLLTRSNFKFEDIAKWLSKRFGIALSYKDKTLNYKEKTNVAGCPISGRLKNLLGDNWKSMLIPVDKEKVNRTTGEVKKITYNYEDIWHICFSYDESEFVYEFGIKRLGYNEIKANELVRIWGAIQQGYGMLSLKAIRNINPFLKQGYPYTEAVLLAKIPELMGSHKWEKYGQLVEKSISDIIVKNRFEKRILNIVNNLIGNYKSLQYNDEGFATKEVNYLLDEKDKEQIEEFCIANYGAKSWSEMSVEKRGVVLDVVREDYQAFFKTEKRDFFKIPKVSDALKEFLSKKFEMFRCENYEEYSHQNNCKCDACKKLNKLYHPSQIAFYPPAIAQSFNYNGVQLSMKLLESPVIGSFKNPMAMKALHILRKEINKLLKEGIIDEDTRIVVETARDLNDANKRWAIRKYQGEREKENDEISKIIQTYFNTNRKISNDEIQKAKLLIDQHEIPVEDGMFEKNVKKYKLWLEQGCRCIYTGKPLNLTSLFSENNTTDFEHTIPRSKSFDNSLANLTVCDAYYNRTIKKNKLPFELENYEKTARIGDEEYPPIKDQLKHWKKKVERLQDNVNNWKFKAKRAQDKPAKDFAIRQRHLWEMELDYWKNKLERFTMKEVKSSFKNSQLVDTRLITKYVFHYLKTVFNSVDVQKGEVTADFRKMLGVQKAYEKKDRTKHSHHAIDAATLTLIPKSAKREKMLSLFYKIEEHKKLNKDTPELQEELNKERLSCNFNKVKNMVPFIEDKILIKHESKNQALAPAKKVVRKRKKIVKVKNNRGEKVSMVAKGDSIRGQLHEETFYGKIKALDKKDEFWMVGRKKIEELNPKTDIIVDKALSEHIHQQIDNGVELNKLKDKAGNTIRHIRCRVKAGRGFLSPDDVTTVKQQTYLSRYDYKNYYYANSGDNFGFALYVDENKKPLKIIPKSLFEVSKQDIDEHKKIEDYFERNIMVGRGQRKKIGELYNVFQVGQHVLFYVDDKEELKHTDNLSSHLYVVKTLFDGKTGRIQFQHHLEARTDEQLIRDFPDKDENGKKLFGKAGKNGFSSFGLDFIRPRLLLTVGKLNCIYEGKDFEFKADNQIRFFF

SEQ ID NO: 963 - protein, 1128 aa, Lutibacter profundi
MTKILGLDLGTNSIGWAVVDEKKEKILGMGSRIFPEGVVNIGEGEGRETSKNASRTDARGTRRQFFRRRLRKRYLLRELAKKGLCPINYTLVKEWNEAQIFKNKQLQEWFKLNPYELRSKAIQEKISLEELGRIFYHFIQRRGFQSNSRSAGVDNIEKSVIFKGDTKTGKIGISETLESIKNTKTLGSYLHTIYPKQNKPYSGHKERIRNRYTTRQMYIYEFETIWEYQKQFYSELSNELKTVLGGRKKDGYKEDGILFHQRPLRSQKHLVGYCSFEPKKTKCQINTIPFELFRIYQWVNTVDCNEKVTSEDRGKMVELLLSKEKVSFKEIRKVINKSDGYYQFNYKNDDKIVGSYTISNLSNKKFFGKKWFDFSDKEQEDIWHVLSFFDDRDKLKQYAIKYWGFNEEKAVKISKFNLKEGYSNLSRKAIHNILPFLKLGFMYDVAVGLGGVKNALADKWIENEQFILDNVPSVVRSNFKGGYIEPLKQMLKYEFDVSDKQLLKLYHHSSAIETTELLKKLPINSEADKEIQSIKNPVVITALFEIRKLVNEIIDTYGKFDEIKVELARDLKASKSKRYDTRREQLRLEKENDRIKIELENLGQRINHITILKYKLWEECDKRCPFTGKNIEVNELFSGEVQIEHIFPWSRSLNDSFMNKTLCFADENRAKGNKTPYEFYSEQGEQKWEEIKIQALSCFKNKPNYPNAYQKFKQFVKKKHDEDFISRQLNDTRYISKEAKNYLSKICNNVQVAPGQMTATLRHKWGLNTILNKDDDTKTRDDHRHHAIDALVMACSTRSHLQELSKRNRYQKDYEFKDFPMPWQFFRQDAEKSVEQILVSHKKLNTILTVRTHKTKKNGVVYKNIGVAARGQLHKETVFGKRTAPDGIEAYHVRKPIESLSTHKHINKVVDETIRLLILKQVNKLGGFVKGKIPEGTFYNTDENGNKQPQIFLPNKNGNPVPIKKIRLRENIGGAEQLKSTVNQHVNPRSNHHVLIYKDFDDNLKEKVVTFWTAVERKKQKQAVFQLPENGKEIVTTLQINDMFLLGLKDDEINWEHPKFTLLKEHLYRVQKFTSGDYYFRKHIESNLNGELGKAYQYIKGFGEGKTGWKTFNPIKIKVSVSGKIEKV

SEQ ID NO: 964 - protein, 1486 aa, Flavobacterium columnare
MTKILGLDLGTNSIGWAIREDENEGVNQIIDKGVRIFSEGVKSENGKEISRAAERTAYRSARKIKYRRKLRKYETLKVLSVNGMCPLSVEEVEQWKKSGFKEYPLNPEFLNWLRTNEDKNINPYFFRDKASKQKVTLFELGRALYHIAQRRGFLSNRLDQSAEGVFEEHNPQIQNLIEDLDSSNTILNELKEYYINLGIIDESEKSGFKKDLDEGEKNLKKLYTSLVSITKKNANDIETCKQELIARLNKKEDLGKVKGEIKDISQAMLDGNFKTLGQYFFSLYNKTRIRNQYTSREEHYLEEFIIICQTQGIEEINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKNDFNFEVLAKELVEKGASFGYYKSSKKNEFFYWFNYKPTDSVSACVVSASLENAIGKDWKTKTFEYQTSNTKKEEVTKSVNYKDLWHLLSVATSDTYLYDFAIEKLKLEPKNAKAFSKTKLKKDFASLSLAAIAKILPYLKQGLLYSHAVFIANIENIVDADIWKDKEQQKFIQSKIVDLIDNYLVEKSKLEIINCLLKIYNTEDIEGRKVYYSKEAESLFEADLRKKLVPFYKANTISEQQEQEIIFKDLFPVLIEQLKKQEFIKIVRLDKKIEAFLKGENEEGQIFCNYPEKFKKLYHPSDIEVFKKKIIKDEWGNEKVVLGSPLTTSIKNPMAMRALHQLRKVLNTLILDGQIDEKTRIHIEMARELNDANKRKGIQDFQKEREELYKIYEAKIKELYQVKTGKELLHVTDEDLQKFEWALEQTKDGRIITKEELIKYKIWEEQNHICIYTGKTISIDSFLGGNPKFDIEHTIPRSISQDNSLMNKTLCDKDFNRSVKGKKMPVELSNYNEILPRIAHWKKQAEELTRQIETISRSIKSAATKVAKDKNIRKRHYLTLKRDYIQGKYDRFTWGEPKVGFKNSQIPDTGIITKYAQAYLKSYFKRVESVKGGAVAEFRKLWGIQESFIDENGFKHFKEKDRSKHTHHTIDAITIACMPKDKYDLLAHAWRLEDEQNKKAAKALIEQAKPWKTFKEDIEKIEAEILVSHFTPDNVKKQAKKILRVRGKKQYVAEIERNANGKAIPKKDASGKIIYKLNERGNKIPILQQGDTIRGSLHQDSIYGAIKNPLNTNEIRYVIRKDLESLKANDIENIVDENVKAKVKEAVANKILLISSNPQQKNKFAEGKNVWMNEEKKIPINKVRIYANSVKNPIEIKKHSTLSKSKHEHKQTVYGQNDENYAMALYELDGKREFELINNFNLAKLLKQGQGYYPLHKEKEIKGKKVLIPIEKRNNRDVVLKRGQQVVFYDKTVENSKDISEIVDFRGRVYLIEGLTIQRQKDKKTGKVNEYGIIQLRYFKEARKSEEISKDSFKPDGEFKINENKPTRKMNHNQFTAFVEGIDFKVLPSGKFQKI

SEQ ID NO: 965 - protein, 1509 aa, Chlamydia trachomatis
MITLGLDIGVSSLGTAIVDTQNNQILHTGVYVFPAGKEAFGTNKEKPKNETRRVARQGRRQNYRRRLRRSQLLKFLYQLSELNSPEGDRYVPLTFEEIDAWLSWDKEGKTAARQFPDSDAFRAWMAMNPYEIRSRAVEGSITRAEFGRLLYHIIQRRGFQSSRKMKTDEGAMAKGSGAIIGYTQTKSELGEQTLGQYLYQISAKEGEPFSQREEKPRGRYTLRSMYVEEMERIWGQQSKRLGLEGLEIEGTPVKELLLGQISHDPESGELLYKSNDSVLFYQRPLRSQKHLINKCSLESRKMYDPLKQRHYIQGPRAAAVSHPTSEFHRALQVLSNVRVEGRTLYDMGLFQTSLDFLCSKNSKTIKVADLKRHLSLVSKLNYDDDQTLPGCPTIASITDLFEKDELSYHYGETDTIYIDIWQKLLFYDDERLLEKNIADYAKGKGLKLKADFAKRLEGINLVDDYGSISIHAMDNIIPFLLQGLSHTEAIFLGGVKNAFGPRYYYFEKEEQMWQELLQIINEPASKGEKIDRLIEYLSNPDEQTGLDEKRLRMKLYHPTQSVQKIEIQNRLGMVDNLRNPIVEQALWAVRRQVNALIDQMIEQTGNPNFRFDRITIELSRDLKSSLDRRLKIRQEQEANRAENEEAVIELRARGVRVTRDNILKYRLHKELQQQDGIARCPYTGKNINPSHLYDGNNFFQIEHIIPRSISLDDSFGNKTLCESNFNREKGNKTPYEFYSVNSSKALWGAEDWDEITHRVRRVLPARKASRFLSKRSAQEQLEELPSKMLNDTAYMSVKAREYLTSICGDVRSVTGHITADLRRMWQLNKILGETYECAPGAVSEELIARGDTDVYALLDSESQVVNRVAPKLHLIPNPTADEIRIPVVVKGTKLYRDGKEYPKPAHLDLNGVTGEALIAYHAVGGTPYCQPLFNPKPSTKDMLVVPATINSKNQLTSDYIEALRKVKKSQYPTDPGKYWVTLQLKGEPIWELPSNKKRATDNAVRVSGRLNGNAFWSPLFETEVDSGVVNMEEHRNRTAYLNLDYDTAEFTKMLRPAPEVGVGELLLTGVANHGLLLLDQCDGKTIDVQHLNLQEQTKYYVSLRYGETLSPEERVTIYPLYAKTPTPRGGEVLLEGKLFLLDKSQGLYALEPVKNRDDHRHHAVDALVIALAKQNYVTELSTYNRQDDSYRQGEALKPRFDLPWKGFREEAEQSINDILVVHKKNRVAPLSKVTRKITKKGKVYTSEGYAVRGALHKATIYGQRKAPGETEVGYHSRKSIAEVTKMSQLNKVVDAAIRKEMLRILKEEFGLDISNPKLVFPKNAFIDEEGKTKVYLPNRNGGESVPVKKVRLCDRFNNAVRLKETNQYVDPQNNHHVLIYQDQDGNLQESVVTMWDVVDRRNRGEEIFQLPPDGKRILFKLMRDRMYLIGITREEILLHLSDTAYLSKYLYRVQKLSSMYYVFRKATASTTNYDREMIRVQSLPFFEPDKDNIHSVEITLTGQVKLKDD

SEQ ID NO: 966 - protein, 1361 aa, Streptococcus varani
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKSATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 967 - protein, 1055 aa, Staphylococcus haemolyticus
MKTDYILGLDIGITSVGYGIINYNDKSIIDAGVRLFPEANVENNEGRRSKRGARRLKRRRIHRLERVKQLLLDYKLLDSIDVIPQSTNPYEIRVRGLREKLTKDELVIALLHLAKRRGIHNIDVIDQEEDASNELSTKEQLSKNNLLLRDKSICEVLLERYNEGKVRGEKNRFKTSDIVNEIRQILETQKEVHHLDDSFIDKYIELVETRREYYEGPGEGSPYGWGADLKKWYEHLMGRCTYFPEELRSVKYAYSADLFNALNDLNNLVIQRDGLNKLEYHEKYHIIENVFKQKKKPTLKQISNEIGVNPEDIKGYRITKSGKENFTEFKLYHDLKKILKDQSILENIQLLDQIAEIITIYQDKESIKKELEQLTEPINEIDKESISDLAGYNGTHRLSLKCINLVLEELWHTSRNQMEIFAYLNIKPRKIDLQKANKIPKDMIDEFILSPVVKRTFGQAINVINKVIEKYGVPKDIIIELARENNTKDKQKFINELQKKNEKTRQRINEIIGKTGNQNAKRLVEKIRLHDEQEGKCLYSLESIPLEDLLNNPNHYEVDHIIPRSVSFDNSYQNKVLVKQTENSKKGNRTPYQYLNSGEAKLSYNQFKQHVLNLSKSKDRISKKKKEYLLEERDINKFEVQKEFINRNLVDTRYATRELTNYLKAYFSANDMDVKVKTINGSFTNHLRKVWDFNKERNHGYKHHAEDALIIANADFLFKENKKLKAANKVLEQPERKEIETKIEVNSDENYQDLFVIPQQVKEIKEFRDFKYSHRVDKKPNRQLINDTLYSTRVKDDDLYIISPIKNIYSKDNTDLKKHFNKNPEKFLMYQKDPKTFEKLEVIMKQYANEKNPLAKYHEETGEYLTKYSKTNNGPIVKSIKMFGKKVGNHLDVTNQYNNSRNKLVKLSFKSYRFDVYLTDKGYKFVSITYLDVLKKENYYYISEAKYDKLKLNKGIDDKAKFIGSFYYNDLIELDGEVYTVIGVNNDKNNVIELNLPEIRYKEYCEINNIKGSGRLRITIGKKVNSIRKLSTDVLGNRYYQSFAKKPQLVFKKGI

SEQ ID NO: 968 - protein, 1175 aa, Mycoplasma arginini
MNKKDVTIGFDLGIASVGWSIIDNKTNDILKLGSRLFQEREKAEDRRNFRNIRRRIRRRKYKKEKFINLVLKNKDIFGFSSEKEIYDSFEKNSENWPNILDLKIKALNQKIEKSEIVWLLHDYLKNRGYFYATNEVNINETKQDNCFPSELLLDFYKENNFFKSNSSISRENGGYTFSNKDWTKEIEHMLTVQEINTKFSEKYIFIFNYVRPFSKGPGSLNSASEYGIYNYDENGRIVKKYTNIWDKTIGKCSLFEDEKVISTSYPSYEIFNLLNDLANIRPVNEKEQWALSPKNKEELLNNLFHNILNKTKAQSITIKQIEKIYIKEKGLEDISDQLKGKNLLKQFGLNNNLTTLNSINKLLKIIKNFSSKYNEINTKNIWVLLPILDDICSIIEVPRKLDEYDEYYKLFSEHEIIDKLFISGEAEEDFIKQIISIKELNFNKKGSLSKKAIDLYLSKMRDLKNNSEFIKWNDKELKQIVIERKEKSRINPNNKYIDPFIFSDDILSPAAKQTFEQAIKVLNRIIKLYSNEYNIKSIVVEMPKTKNDKETIEKYNQDNVKKDFEGIIKLLPINITVDELLEKKTNSLLEKLKLYVQQDGIDLYSMQKMDIWEVINYPGNFEIDHIIPYSLSYDNSVGNKVLTTKANNQAKGQKTAMEYLGSLNLFNIDEYKTKCAQLFLNKDTFTKNKNNIVITEKNAENKYKNLTWDNFNESNKNEFINRNLNDTRYAVKLFVETLRKHFDNKETKIIGINGHVTSYFRNISFLPKNRNFNYHHAIDASIIALVINNNKYIARLLTIADNEWKILNDHQMIQKFTGEVKEITDLDFKKNIMAHFVSKIIKEKINLIVENNYELVQFSRKIKIMNNAPLFDQTLYGLKQTETNDQDKVYKVVKINLIKEKNKKLQKYFENPIVEEGRKKYSVLMAQSHLKEFNNLKEIFKKYNLKNTGSAFIDYMNDLNSNFPELVTKKMIDNAIATNRVIYLDLNNMKTRYYKDLRIVEKSLIPINFKYNNGKSFKDTNTTLFSLVYKNENNNYNSIPINFLTYKFGIKNNNLLDENIYNKNNLEKYKENLKISFSEKPLFAIKQGTILRRKNLSENWFENLYYVSGISKEEDKDTRYTLTNLIKTKPLNKENKEEVKTIISKLTNPLLKEFDIIYLDELGNEYKANISNLDC

SEQ ID NO: 969 - protein, 1114 aa, Chlamydia trachomatis
MQFHFYMVYVTIKDMNCKDASQQLRYRVGIDVGTHSIGFCAVEVDESHMPIQLLNSMVHMHDSGIDPDENDKAMTRLAKSGVARRTRRLIRRRKKRLQELDAFIEECGWPLVDLATITDARSPWRIRARLATEHIDDEAEQNKLLSIALRHMARHRGWRSPYARISSLHIQADPSEQLKALAERVSEKTGISLTADQTPAQLISVYLDVFETGKLRGPQGILGGKLMQSDNANELRRIATVQGLDNDLLKKIIGFVFAAESPKGSAAKRVGKDILPGAHGPRAEKAHPAFQQFRIVSIVQNLRIKEGTGCRALTPEETEIVVDFLNQAGLTKAPTWEEVADNLEIPRSHLRGTATEGFDGIAPSTRPPFDVTSQKILNGKLKKLSTWWKDADYHHRCAMVNALSNVGSDDEGSLADDDVREFLSNFTDEELEALDKVELPGGRAAYSVDSLEKLTNTMLSEGCDLHSARKLAFEVDDSWTPPAEPIGQPVGNPAVDRVLKQVARWISAATNQWGTPESVNIEHVRDALGSEKASREYQRSLQTRRTRNEKLFAEMRERLDIGGKPRRSELTRYLALQRQNCQCLYCGMPITYTDAEMDHIVPRKGAASTNTRENLAAVCRACNHQKSNLPFAVWAEKTERPGVSVKEAYKRVSDMRIEPGMNGREMNEFRKAIRLRLTTKHADAEIDGRSLESVAWMANELRHRIEGFYRSAENDVTVRVFRGAVTAEGRRASGFESRVNLIGGKGKTRLDRRHHAMDALTIALMEPEIAQTIALRMNMRDSQRVLGEQETWKSFTGGSDTTRKNWEHWCEEMVRASELFNVFLAEDRIPICQNKRLRLGSSAVHKAIVQPFKASDKRIVSDAMPVELIDRASTPALWTALTRDPDFDPKEGLPANPSRTIRLHDKRLGPKETVDFFPTAAACLAIRGGYCEIGAGIHHARIFRISGKKTTYAMLRVYQCDLVRFQKEDLLTVELPANTISVRTAVPKLREALANGTAEQIGWLVVGDELKIDPSGFTTGQIGTFNETYPQATRWEVTGFPDKAKLGLKPLLIASEGLADDAPDDIVKIVERPGWRPAIDKLLKIGNVFLYRRDTHGKPRVVSHRSLPLSSKLQ

SEQ ID NO: 970 - protein, 1330 aa, Enterococcus massiliensis
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSKKTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLINDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 971 - protein, 1697 aa, Dysgonomonas sp. HGC4
MKKILGLDLGTNSIGWALVEVDHEKKIVKIIGLGSRILPMDAAEIATFETGGKLPSSAAQRREKRSPRRLNERYLLRRDRLHCVMNLLQSLPEHYQLSIEFENEKGKRSGKFKKGIEEKFAYYKDDNGKYQFLFMDAYQEMENEFRQQHPNLFYVKNNSKQTKIPYDWTLYYLRKKALQKTNNELTKEELAWITLSFNQKRGYEKVIGQDEKEQKDGILLETFTGKVKNVIKIEDKDLYEIVLVEFNNEENELYRYKEESKVQITFKNDLKEIEIISKYDDEGNVDSEKAEYIINEIRESLLVLNVRNTGRRNKENFIFEIELETGWIKEQQSRFTPDWKGTSRDFIIKTKYDKDGNRIPRGQDKGRSISIPKEEDWSLMKLKTETSIHSFNTKYNTTGVAPYIYYNLLQNPNQKVKAGLVTVIEREFYEKELEAIYNSQEKYHPELNNRELYRQAVQLLYPNNKTRRDALINLDFKNLISTDIMFYQRDLKSKKSLIADCDYEKRNYFNKEIGVVCKQPLKAIHAANPLYQEFRLWQFIKSLKIIKCEDVIGDEILINQDVSRELLTLDIKEKIFEFLNDRKEITQKQLLKKLSELHNEKTISSNNYKWNYPEYDDEDKKNEYKIICNPTRSEFIIRTKKIKNFYWDTFLSPENEYLLWHFFYSVKKKSEFSSGLNSLVEKLLKRAGLPADYKSNLVKSFSTFSGYKNDYGAYSEKTIKKLLPFLRIGKYWKREDVEQILENRPSDILEKVEIVLDKVVTKEEINGEITDFQGLWLSSACYLVYGRHSEVGDVKFWTSPYDIENFIRNEFKQHSLNNPVVEKVLIEMLQVVKDIWMYYGLKAGIDENGKFTYNKLFDRIHIELGREMKKNNKQKQSDDKKNSENRKTNNRIIELLKDLKKENPSIQEKSPFQQEKLKILEQGVLASIEYEKDNVSYELLNSSETISKKEIKELVSEDISKVSKGVFERYKLWLDQRYQSPYTGKFIKLSDLFDRTKYEIEHIFPQERLTLNSLENKVICETEVNKDKKANTGYEYILGANNKLIRCAAHGYKEIPILSVDDYKELVNRNFIGKKRDILLCKDIPDEFTNSQKVNMQYISKMAVKLLSNIVREKDEDTYRSKNVLATNGTITSTLKKHWQLNEIWSDLMSPRYKRLNKLTESTLFGDIRIMNGHEVFVNNNQIPQQINKNFDPKRIDHRHHAIDALIIALTTENHVNYLNNISSQDKGEDKLKTRKIIKYQLTDTKRGDNSTKEWYFLPPAQLKTKEGIINYNYEYKDISGNVFKDIAKTALEDTIASFKQKNRIIRQRWNKYSTLENGSIVIKEQEGLSGKENFSIRQSLHKSTFYGKVKLAYKTSNIKLEEAIFEDYDIVDNLLSKKIEDMKKQLSISEIVACLSVNYPTVRVYDKFVATRYGCKLESLATISSDKEVKKMIESITDTGIQEILQNHLKNYDSDPQTAFSYDGIRALNEAIVKPKHGLTKKGKPHKPIYKVRMADVMGAKFSVSEDGQKSTKYVVTDAGSNAFCGVYEIKKGERKFYIPTLKELLNNLKNGENPCPGSHPDFPEYNWIFNLCANDLVYLPTQDEIDNDNKTPVDIDSLDKSRIYKFTDGSGTTLNFVPVNFASLLYGFPKNVARKNAENLKKEHSLEYTDVLLQNELGLGSPQSKNQNSIDRIQIKKYCIKLDVDRLGNIKPLLP

SEQ ID NO: 972 - protein, 1381 aa, Enterococcus thailandicus
MPKFVYGLSLILTRYVVLNATNKYILSHIREYTTEIFFLFFTRIVTEENPGGVKMKKNYTIGLDIGTASVGWAVLTEDYELIKRKMKISGNTQKKAVKKNFWGVRLFEQGETAEGRRLKRTTRRRIARRRQRIQYLRTIFDEGMNQVDANFFARLDESFSIIDEKENERHPIFGNVAEEAAYHEQFPTIYHLREHLANSSEQADLRLVYLALAHIIKFRGHFLIEGELNTENSSVSGTFEQFIKVYNETFNVEKALDLTVDLDGIAEQKISRMKRAELILSLFPEEKSTGDFAQFIKMIVGNQGNVKKTFSLNEDAKIQFSKEEYEENLETLLAEIGEDFRSVFDAAKSVYDAISLANILKVTDATTRAKLSSSMVVRFTDHKEDLKTLKRFVRENLPDEYDDLFKNKKVAGYAGYIDGNETQEAFYKYLKKTLAKATGAEGFLAKMEQEDFLRKQRTFDNGVIPYQLHLEELKAIIKNQKSYYSFLDEEKISQLMTFRIPYYVGPLAKEKGQFAWLTRKEMGKITPWNLNEKVDIEKSATDFVERMTNNDSYLPMEKVLPKHSLLYETFTVYNELTKVRYIDDNGRAQNFSSKEKRQIINELFKQQRKVKKEMLEAFLKNEYGIENPKVEGIEKSFNACLGTYHDLIKLGIRPELFEQPEHEQQFEQIVKILTVFEDRKMRREQLEKFSNILTEEEQKQLERKHYKGWGRLSAKLIHGIVDQKTQKTILDYLIDDDDLPKNRNRNFMQLINDENLSFKEEIEKIAFDNDKSTEEIVQELAGSPAIKKGILQSLKIVEEIIDIMGELPTNIVVEMARENQTTAQGNRASKARMKYLEESIKKLGSSILEDEPISKDANLLRNDRLFLYYLQNGRDMYTGNELDINNLSSYDIDHIIPQSFVKDDSIDNRVLTTSSMNRGKSNTVPAESVVKKMRPTWERLLASGLISKKKFSYLTKATNGGLTEEDKAHFIQRQLVETRQITKNVAQILHQKYNNEQSSEKPVRVITLKSALASQFRKDFSLYKIRELNDYHHAQDAYLNGVIAQALLKVYPKLEPEFVYGEYQKVSIRALNKATAKKEFYSNIMNFFTSDEMVANEETGEVLWNRQRDIKTIKKVMNYHQMNIVKKVEIQTGAFTKESILPKGPSKKLIARKNNWAPVNYGGVDSPTVAYSVIITHEKGKAAKVVQQLVGIKILERQAFEQDEVAFLEEKGFIHPKVQLKLPKYSLYQFADGRRRLLASAEESQKGNQMVLPVHLIELLYHAKHVSDSSGKSLEYLNEHRHEFAELLEAILQFTEQYIDAGKNQKKVRDLYEKNQDADMRELASSFIQLLQLNKQGAPADFKFFGETIPRRRYKNTAEIVDATFINQSITGLYETQRRLV

SEQ ID NO: 973 - protein, 1072 aa, Shimia marina
MRLGLDIGTNSVGWWLYKTDGEAASARIVEVIDGGVRIFSDGRDPKSKTSLAVDRRVARAARRRRDRYLRRRASLMKLLARTGLMPADPVEAKKLERLDPYELRSTGLDDALPLTHFGRALFHLNQRRGFKSNRKTDRGDNENGKIREATARLDLEMMTSGARSYGEFLHMRRQRASDPRHVPSVRTRLSVAARGGPDAKAEAGYDFYPDRHHLEEEFHALWAAQATHHQALTDDLRDLVFEKIFYQRPLKEPKIGLCLFTAEERIAKAHPLTQRRVLFETINQLRVTADGRSTRPLTLEERDTLVHALDNKKPTKSMTSMNMTLKALAKLLKLRDGERFTLETGVRENISCDPVRACMAHPARFGPQWSSLDWEAQWDVISRVRQVQSEGEFIELTDWLIQGHGLDADHAKAVGNAPLPEGYARLGFSATERILDQLKAEVCTYSDAVAKCGWHHSDQRTGACLEVLPYYGEVLDRHVIPGTYDATDDEITRYGRITNPTVHIGLNQLRRLVNKIIEVHGKPDQIVVELARELKQSEPQKKDAMKRLRNTTADAIRRSEQLEQLGQPNTGHNRMLLRLWEDLGPAIGPRCCPYTGKTISVTMVFDGSCDVDHILPFSRTLDDSFANRTLCLKEANREKSDRTPWEAWGGTDQWDDIAANLKNLPEKKRKRFGPDAMEWFEGENDFLDRALVDTQYLAKISRMYLDTLFTKGGHVWVVPGRMTEMLRRHWGLNALLNDKDRGAVKAKNRTDHRHHAIDAAVVAATDYRLMQKISRAAGQGENAGQSAELIARDTDAPWEHFRADIASQLEKIIVSHRADHGRIDVEGRKTGRDSTAGRLHNDTAYGVIDDLTVASRTPLMSLKPSDIAITERGKNIRDPQLQNALYVATKGKEGKMFEQALVDFASKEGPYQGIRRVRLVETLQKAARVEIGKTESGQPLKAYKGDSNHCYELWKLPDGKIVPQVVTTYEAHAGSAPRPHPAAKRILRVFKKDMVKLTKDGEEIVGYVQSMHIKNGLFVAQHLEANADARNRDKTDPFKFLQMGAGTLVKTGLRRVLVDEIGRLRDPGPPKL

SEQ ID NO: 974 - protein, 1375 aa, Lagierella massiliensis
MKNFKDYYVGLDIGTSSVGWAVTDDSYNVLKFNSKKMWGVRVFDEAKTAESRRLQRGAKRRLDRRKERINLLQDFFAEEVSKVDANFFLRLDNSDLYKEDKDEKLKSKYTLFNDKDFKDKDYHAKYPTIHHLIMDLIEDDSKKDIRLVYLACHYLIKNRGHFIFEGQKFDIKESFDTSIDNLKIHLKDEYFIDLEFDNSDLIKVITDDTLNKSEKKEKLKDIVGDTKFLKAISAIMIGSSQKLNGLFGYDEELKNETIDFSKSDFDEKHGDFEALLGEKIALLDILKEIYDSSILENLLKEADKSDDGNRYISQAFIKKYNKHGSDLRKLKSIIKKYLPSNYDEIFREENIQDNYVAYTKSNITNNERKKATKFTSQENFNTFIKKKLEIIEKDIKEEDNEDFIILNEMLNDIKEKTFMPKLKSSDNSIIPYQLKLIELERILDNQSKYYGFLNSSDKYGTVAEKIASIMKFRIPYYVGPLNPDSKYAWIKRSGGKITPWNFEDVVDLDSSREGFIDRLIGRCTYLKEEKVLPKSSLLYSEFMVLNELNNLKLNGVIISEDMKKSILENLFKTKKKVTLKSVSNLLKKDFNITGEVLLSGIDEDFKQNLNSYIDFKNIIGEKVDRDDYRKNIEEIIKLIILYGDDKNYLQKKIKSAYGEYFTDAEIKKIISLKYRDWGRLSKKLLVGIEGVNKDTGETGNIIHFMREYNLNLMELMSSKFTFVEEIQKSKPIDNRKLCYEMVDELYLSPSVKRMLWQSLRIVDEITGIMGNNPKKIFIEMARGEEEKKDRKNSRKKNILEFYKKGKADFIKEIGEDRYNYLVSEIEREEEPKFRWDNLYLYYTQLGRCMYSLEPIELSDLASKNIYDQDHIYPKSKIYDDSIENRVLVKKNLNHEKGNMYPIPEKVLNKNCYSYWKMLHDKKLIGDKKYARLIRNTAFNDDELLQFIERQIVETRQATKETANLLKTICKNSEIVYSKASNVSRFRQEFDILKCRTVNDLHHMHDAYLNIVVGNVYNTKFTKNPRNFIKDKEENKSYNLENMFKYDVKRGNYIAWIADNHKGSIKDATIKRIKKEIQGTNYRFTRMSYIGKGELYNQNLKRKGNGQFPQKENSKKFDINKYGGYNKAGSAYFALVESDGKKEREKTLETIPIIVNNKVKNGEKDAIYNYLTKNLELKNPEILVNKIKINALIKLDGFFYNITGKTNDYYLIAPAVQLILDKKDEKTIRKLEKFLSRKLKDKNAKVLKSDGIESKDILSLYDNLSDKLNNSIFKYRIKNLSEVITSGRDLFINLKKEDQILVLKEMLLLFQNINNGVDLSLIGNVNKKTKKPIKASGKTLLSKKINYNEFKLINQSITGLFENELDLIKIWPGELL

SEQ ID NO: 975 - protein, 1031 aa, Acidovorax sp. MR-S7
MPAIYRLALDLGSTSLGWAVLRLEPAALEPIAIIKAGVRIFSDGRNPKDGASLAVTRRAARAMRRRRDRLLKRKARMQDKLVKHGFFPSDMDERKALERLDPYALRAKGLREALTPGEFARALFHINQRRGFKSNRKTDKKDNDSGALKKAISHLRQQMEAGGHRTVGDHLWSRLQQGLGVRARYRETPFTNDEGKKRIDKSYDLYIDRAMIEQEFDALWAAQAAFNPALFHEVARADLKDTLLHQRRLRPVKPGRCTLLPEEERAPLALPSTQRFRIYQEVNHLRLLGEDLREVALTLAQRDAVANALESKARLTFEQIRKLLKLSGSVQFNLEDAKRTELKGNATSAALARKELFGAAWGGFGEALQDEIVWQLVTEEGEGALIAWLQAHTGVDEARAQAIADASLPEGYGSLSRKALARIVPALRAGVVTYDKAVQAAGFDHHSQLGFEYDAGEVEDWVHPDTGEIRPVFKQLPYYGKPLQRHVAFGSGKPEDPDERRYGKIANPTVHIGLNQVRTVVNALIRRYGRPTEVVIELARDLKQSREQKVEAQRKQAENQRRNARIRKSIAEVLGIGEEQVRGADIQKWICWEELSFDVAERRCPYSGVQISARMLLSDEVEVEHILPFSKTLDDSLNNRTVAMRQANRIKRNRTPWTARDDFEAQGWSYEGILQRAERMPLRKRYRFAPDGYERWLGDDKDFLARALNDTRYLSRVAAEYLRLVCPGSGTRVIPGQMTARLRGKFGLNGVLGPDGEKNRNDHRHHAVDACVIGVTDQGLMQRFANASAQAREDGLTRLVDDMPRPWPTYRAHVERAVRHIWVSHRPDHGFEGAMMEETSYGIGKDGSIKQRRKADGSPGREITNLIRIHEATQPQRHGAGPDGQPLPYKGYVGGSNYCIEITRNDKGKWEGEVISTFRAYGIVRTSGLGQLRHPRVGQNGRELVMRLVIGDSVRLEIDGIERTMRIVKISGSNGQIFMAPIHEANVDARNSDKQDAFAYTSKYAGSLQKTKARFVTISPIGEVRDLGFKG

SEQ ID NO: 976 - protein, 886 aa, Campylobacter coli
MKILGFDIGINSIGWAFVEDNQLQDCGVRLFTKAEDPKTKESLALPRRNARSNRRRLGRRRSRLIALKHIISKELKLNYQDYIANDGELPKAYEGRLVSPYELRYKALNEKIEPKDLARVILHIAKHRGYMNKNEKKSSDNEKGKILSALKTNALKLEKYQSVGEYFYKEFFQKYKENTKDFINIRNKEGSYENCVLASDLEKELKLILEKQKEWGYSYNDNFIKEILKVAFFQRPLKDFSYLVGACTFFEDEKRACKNSYSAWEFVALTKIINELKSLEKESGELVSSQIINEILNHILDKGSITYKKFREYIKLHESMKFKSLKYDKDNAESVKLIEFRKLVEFKKALGEHSLTREELDQIATYITLIKDNEKLKITLEKYSLNNEQIKNLIEIDFNDHINLSFKALNLILPLMKEGKRYDEACKLLNLKTKSNNQKFDFLPAFCDSIFAQELTNPIVNRAISEYRKVLNALLKKYGKMHKIHIELARDIGLSKKLRTKIEKEQKENYENNIWALNECENFGLKANAKNILKLKLWKEQKEFCIYSGKKISIEHLRDEKALEVDHIYPYSRSFDDSFLNKVLVFTKENQEKLNKTPFEAFGANEERWSKIQALAQNLPYKKKNKILDEAFKGKQQQDFISRNLNDTRYISTLIVKYTKEYLDFLPLDEKEDINLKSGEKGSKIHVQTINGMLTSVLRHTWGFAQKDRNNHLHHALDATIVAYSTNAIIKAFSDFKKEQELLKAKLYAKELTNDSYKHQAKFFEPFEGFREQILNQINKLFVSKPPRKRARGALHKETFYSKDEMIKKYNSQEGVEIALNCGKIRKIGTKYVENDTMVRIDIFKKQNKFYAIPIYTMDFALGVLPNKIVIIGKDKKGNPKQWQEK

SEQ ID NO: 977 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 978 - protein, 1105 aa, Clostridium sp. CAG:230
MGIRIGLDIGIASVGWAVVDDDYNIIESGANIFNEAKAASNVDRRTFRQTKRLLRRQKTRLRDFDILWINAGLDIPKEKVNKQLQFRVQGMTMELSENELYAALKNMLKHRGISYLEDALDEEQSGKSTYEKGLQVNQKALKCDKMPCEIQYERLMKYGSYRGHIEVKDESGEEMILSNIFTLDAYCKEAKKILECQKQYHSFITEAFEDDYLALLRRKRKYYEGPGNEQSRTDYGKYTTKLNPETGEYVTEENIFEKLIGKCSVYPKEMRASAASYTAQIYNMLNDLNNLTINGRKLEYEEKKSIVEEVQKASSVNMLKIIKKVINEDITTIEGARKDKNDKEIFHKMETYNKMRHYFEKNGLEFKKISTDDLDEIGNILTLNTEKEAILEAFNKSQLELSQEEKEAFIEIRKKNGSLFNKWHSFSLKIMKELIPELYLQSKNQMQLLTDMGVFKKKTEIFQNYDKIPTDVIIEDIYNPVVKRSIRITVKIVNALIKKYGYPREVVIEMPRDRNSDEEKKRIQDEQKKNDTELKKIIEKVESEYGIKITDTHFRNHKNLRMKLRLWHEQDGRCLYSGKVIDISELLNDCSKFEIDHVIPKSISFDDSRSNKVLVYSTENQKKTNQTPYQYLEGNGKEWSFDEYMNQVIELKDRKLISKAKMNKLLFREDITKIEVLKGFIARNINDTRYASRVVLNSFQKYFESKQSDTKVKVIRGSFTHQMRKKLQLSKNRDESYAHHAVDAMLICYSQMGYEAYRQLQEDLIDPDSEKIRDLGLWKETITEAKYDEVLYTAKWLENRGKIQEAEKKVKFWHKVDSKANRALCNQTIRGTRVIDGSIQKINKINIYSVDGYKTFKNMIQKGKEKDFLMYRNDRRSWDDLMKVYREYSDAKNAFAAYQEETGDYVRKYAKKHNGSKITNLKYCAKELGSCIDISHKYGLEKDSRKVILESLSPYRSDVYYNAGLKQYYIVGIKNSDLCFLKGEYFIDSKRYLQILREEGVLTEQHTLNDLAAIGTEFQFSLYENDYLEYEKNGEIKTERFLSRTKPKQKNYIETKSIDAPKIKNKKQNLVGLAKSKSIKKIRVDILGNRYYASKEKFSLMVDKF

SEQ ID NO: 979 - protein, 1380 aa, Staphylococcus sp. CAG:324
MGKYNLGLDIGTNSVGWAVVDENNQIVKKGGKALWGVRMFDEAQSAKETRIYRNSRRRIVRRNQRLLLLQKEFYDEIIKVDQTFFQRLKDSFFKKEDKLNKNNYTFFDDDITDREYFKKFPTIYHLRSHLLYNDEKIDIRMLYLALHHIVKYRGHFLDSGEVNESNFSKIKDVLDTFNNKMSEMSLEFEDNEDYFCKIEFDENFENKLKDIMLSQLSKKEKRQELIDLFKVDKKSLVNELLIELLVNKKVKLNSLSITNGKKYEVCEIDFEKEELFEKLEDAKKIITELFDILDEIVNIKKIVDYYYVLKIIGDNEYLSEAMVKKYDKHDKDLRELKSFIKTYCPNKYYECFRKTSNPNLCNYPKYVGINSVNKKIERFAHCKKEEFYKYLKSLFNTIKDENAKLKIDLFQKDMENDDFLNRQNSNHNSSIPMQLNFCELKKILENQSKYYPFLMLKNSDGYSTSDRIIAIFKYKIPYYVGPLNKNSKYSWLVKKSNENITPWNYEKVIDLDASAKEFIQRMQNKCTYLKGENDYCLPKKSILFSEYNCLQYLNRLIINGALIENKLKNEIYENIFLCYKKPTKKSIVEYLKTNYNYDETTLKSNILEVNCDMSSYIQFKEIYGEDFEQNLNIVEDIIKDITIFEDKKILEKRLREIYHLSEDKVQKIKGLNYKGYATLSKHFLNNFYSVNEETGEIYGPIIQIMRDTNYNLQQVIYNDRYNFMKAIDKYNKKNLDTEKKLNVSDFIDEYIYVSPIMKRSLIQSYNIIQELEKILGESISKYYIECARVRSNSKDVINSRYRQLSELYKDCEHQVSDISKNYININKLKKQLEDNKNELRADKLYLYFTQFGKCMYTLKDIDLDDVFLGKYDIDHIYPQSLIKDDSLNNRVLASKEKNGKKDNQFIFNIPEFLPKNAELFYKKLLECKLITKEKYRRLTMKKIDDDELDIFVNRQLVATNQSVKGLVDVLKIYKGVKPTNIVYSKAVNISDFRNNYNLYKSRTANNYHHAHDAYLNVVIGKALDVYYQCNYFQNYKDVIKLKDRNITINPEIILSKNRYVNRNGEKKVIWDLDNTLKLIKNNLYNRFDITETIMTRKSNKMFSKSSISPAKNSKNLIPIKTSDPRCNVLKYGGIKSNSYNFYCIVELYDKKGKKSYILEAIPKTHSDKLEEYIKNSIDEKNVSNFKIINKNIKSNIIIEYKKLRYVITGKSGKYYLIKNFKDRNFSYNAIKTIKYIEKYNYQKKYEIPFEETKEKIILAPKKKDTKEISLTLDNCQALLDEIISLFKKDIYNYDIIYKITSKLEENKQNLTLTNLIKVLTEILILLKTNERGTADLTLIDMSKDTGTLCISKTLKPGMKFISESPTGYYRKIIFEVPNGI

SEQ ID NO: 980 - protein, 1217 aa, Clostridium sp. CAG:433
MKYNYVLGLDIGISSVGWGLLALDENNNPYKIIDVGSRIFSPGEVEKTGDSKAKERREKRGTRRVIRRREFRLDRVRNLLYEKGYLKGNITSNIVSVKNEELTIIFNDMVNNYYKSKDTNPYKLKVEALDRKLTNDELSIILVHYAKKRGYKSNREESSDNDNGKVKEAIKENTNLMEEKKYRTISEMYIKNEKFKNKIKNGPDDYKLSVTNEMYLEEINKVLDSQIGFGLIDDNFKNEYLEIYNSRRHYSEGPGYYYAKDANGNKVKVRSPYGGDLIKKMTGVCSFDKKARAPKYAFSSELFVSISKLVNLRYKIDDDSYKQLTKEQINELIDEAKNKNKVTYKSLIKILGIKNIKVKDLNLSKSEYIKVIDELKKKLNISKEEKIDIYSLDEENKKIYDDIYNEKLFSKTLIEFKGYNLLKKAITLSYNSGTWNDVKDNIEFLDELALYCTDYKVNNEIQEHIHNSLIIDSRFDDSNFVENLPNFKDHLMLSTDIIRKLIPIMLEGITYDKAMDKIGYNHSNLYKDTIKEDLLVPVYVSKNITNQRVIRSLTQARKVINAIIKKYGSPKIINIETARELAKTQKERRIIEKNQQDKQYENERIKKHLVELELFSDESKITGNDLLKYKLWQEQKEFCGYSMKKIKLEDLFSNNIVQIDHILPYSRTYNDNYLNKTLVYTKYNQDKGNKTPYEWFGKTDKWQEYEAFINSLSISQNKKDNYLLKNLDQDAEREMREQNLNDTKYISRELLSLIKAYLNVDEVNAFPGAITAKLRARWGFNRLTHSYISKTYIMPEDMKKGINKDRDNHLHHAMDALVIASITKSLQQKITLYEKFSRYVDGITKNELGKISTGNINDDLYNYYDEETGEIKELELRQYIKNQVAQNNIYFSKHNVSKLIFPTPYNNFVEEAKLRVYERDLEVLKWNLKNLGTYTSSELNRIHVLIPSVAKNKISGRLHEETYYGLKEVGIGEDKVTYKTLKTPISKVKKKDLDNIPDCKGGSKDIYNALVKWFGNCETGEEALKMHDGKYPVNPNDKEQKEIRKIKVYTKYNATGHVVNNGNVEKGGIYRIDVFKSKNKEDNKLYFTSYDIFEIEQIKAYEKGKNINFSIKLEYGQGKNNKILLYKDVKNEYDLIMSIYKNDLIRIKTKTGNKSTAYVVGFSGGKLEIKSTIGDGYDIIGNNNIFDKSMERYRVTSSTIVKIDKLSISILGEVSGL

SEQ ID NO: 981 - protein, 1104 aa, Bacteroides pectinophilus
MKLILALDIGIASVGWAVLDKKSETVLEAGSNIFPEASAAGNQVRREMRQARRIKRRQRTRLDDFNKLWRKNNLSIPQYKSTEIVNLKVKALREEISLDELYLILYSYLKHRGISYLEDAQDDSLSSSNAYTNGLRENAKALEKHYPCEIQRDRLQTIGKYRGQTQITDDNNEKIDLSNVFTIGAYRKEIKKVLETQKLYHNELTDELCDDYILIFNRKRKYYEGPGNEKSRTDYGRFTTRLDQNGNYIDEENIFEKLIGKCSVYPDELRGAAASYTAQEFNLLNDLNNLTINGRKLEESEKHAIVQRIKTSNTVNMRKIIADCMGETIENFSGARIDKSGKEQFHKFETYNKMRKSLSEIGTDIDEFSRDELDKIGYIMTINTDKEALMEAFNESGLNLDDSVKECLISFRKANSSSFSKWQSFSLKIMNELIPEMYIQPKEQMTLLTEMGVAKGSSGDFAGLNYIPVDVISDEIYNPVVRRSVRISFKILNAVLKKYKVLDTIVIEMPRDRNSDEERKRITDSQKLNEKEMEFIEGKLAQIYNIKLSSSDFSSQKQLSLKLKLWNEQDGICLYSGRTIDPEDIIKNPDLFEIDHIIPRSISFDDSRSNKVLVYRSENQKKGNQTPYFYITHSDGAWTYEQFKANVMNLSKKKEYAISRKKVQNLLYSEDITKRDVLKGFINRNINDTGYASRVVLNTVQNFFKAKEADTKVKVIKGSYTHQMRSNMKLDKNRDESYSHHAVDAMLMGFSEMGYEAYRRLQGEFIDFETGEILKNDMWNEKMSDDVYVDYLYGRKWSAIRNEIVKAEKDVKFWHFIVRKSNQGLCNQTIRGTREYDGKKYKINKFDIRTKEGVKLFKKLAFSEKESDREKLLVYLNDRQTFNNLVKIFEDYKDAPNPFVQYEKETGDVVRKYSKRHNGPRIDKLKYKDGEVGACIDISHKYGLEKDSRKVILESLVPYRMDVYYKESDKMYYLVGVKQSDIKSQNGANVIDEDLYTRILINEKMIEPGQSRDDLEQLGYEFRFSFYKNDIIEYEKEGKVFVERFVSRTMPKVRNYIETKPINKANFEKQNPVGLGKTKSIKKYRTDILGNRYLCEKEKFTKFC

SEQ ID NO: 982 - protein, 1391 aa, Collinsella sp. CAG:289
MNLRNYPGEYSIGLDMGTGSVGWSVVDEKGNLLHFKKKPTWGSRLFDSVMPASEARVHRGQRRRYERRRWRLDLLQGLFKNEMNKVDPEFFMRLNQSRTIEGDPIFTKSFTKADYYDRFPTIYHLRAYLMESNEPADLRLIYLAMHNIIKHRGNFLREEEKSLSAKHADSKKAVTQFVDALKEWCFSRGYEFGKDPAKSIEKCLSDSKSSRSQLASEIAKALAVSTDAAAADKKLADNLAKAMVGLQCEFKYVFGEFDCESTKLALSDDEKLELLRAACPDDSVELLDALCAVYSAYVLQGLLSYAPGQTISHNMIAKYDLYKTDLKTLRALVREYAPGAYDEFFRGATYHDANPDDSSKDYSYADAEGYTAYNLHKLSYDDFAKAVKKLLGGTDAVTDERYLNMMERFEKQQFLRRLKTSDNGAIYYQLHLEELTAIIKNQGRFYSFLKEYEGKFESLVSFRIPYYVGPLTSVNAAQDSHNHNRFQWSERKPGMEREVITPWNWDTIIDKNKSAENFIMRMTGDCTYLAGEKVLPKQSLLYEEFCVLNELNGVRWSDDGDDWQRFDAAQREGIVRELFHKYRRVTYKMLEDWLVREGDANHPIVKGGQGETGLESKMGSYLFFAKGIFGLGELSPAEYPAIEKMIKWNTLFEDRSILKEKLEDEFGERGNGMLDASQIKAICKKRFTGWGRLSEQFLTGLKVESPAGRAVSIMDVLREGNPCSERRQGETVVMMEALRDEGLGFQKKIDEHNRNYYGQHGKDLGVNELPGSPAIRRSLNQAIRIVEEIASIAGHAPANIFIEVTRGEDAGKKGKRTVKRWDKIGEALKKLKEEGVAVEVMDDFKEQKAINANLDERLSLYLMQNGKCLYSGKAINLEKLLAGSGEYEVDHIIPRAYIKDDSIENKALVLREENQHKTDQLLIDKSIRWKMRETWSQLHDAGLIGDKKYHNLLRSNINENQLRGFIARQLVETSQMVKLAQALLEARFANEETRIVPVKASMSHNLREAADLAKCREANDFHHAHDAFLASRIGLFVQMRHPGIYENPIGYSHVIKKYVQEQSEVFKKTHRMPGSAGFVINSFMSSGFDKDTGEVFKDSWDAEAEVDGIRKALNYRQCYISRMPQQDTGAFWNATVYSPRDPKMGPKLALSTKQGLDPKLYGGFSSQQFAYFFIYEAKKKGKPTFRFSQVPVWLAARIEANPLALEEYARGLAKGEGLEFVSIQRPKIYKKQLIEVNGDKLIITGAKEVRSGAELAFNQDEISAISMCSKLRAAEAGLDGAFSEEVSAIWNRISNAPVQSCGRLLRQLTLPKYQSNFDSSSNEEKAAVVLGLIALLNGNNRIVDLSGVGGSSHAGAMMMSYPKLLDDPKVPFFIIDQSVTGMFERKTRVGL

SEQ ID NO: 983 - protein, 1378 aa, Lactobacillus fermentum
MKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 984 - protein, 1380 aa, Peptoniphilus sp. oral taxon 386
MNTKFNDVDYYVGLDIGTSSVGWAVTNEKYELLKFNNHKMWGSRLFEEASTAQDRREHRSNRRRLERRKYRLDLLEELFVEEINKIDPEFFIRLRESKFHFEDRSLKNTFILFNDKMEGGYNDKVFFSKYPTIYHLRSALINGNKEDVRAVFLAIHNILKNRGHFLLAGNDINISLSLNDTLTDLFEYLKIHLGIEVEFENKLKDIEKIALDKNLSKSDKQKKIVQLLETDYKKQLADVFKLSLGLTANMENIFGKENEQGLEFINAENKIKKIQFDSSYEENIAEFDQFYGEYFEIIDICKKIYDAISLSQILVDGKGLSESKVLSYEKHKEDLKLLKKVLKNIDKAYDNKGEDRLVYKVLKEDKDKGTNYVNYSKLSNNGTATTKEEFYKFLSKNLDLKKFGKLNKEDIETLDYINSEILLGRFLPLQKEKINGVIPYQLQMKELTQILNNASKYLPFLNKIEDGMTVKDKIISLIKFRIPYYVGPLNEYNRIENGNGFAWIEKKKNEKIFPWNFNDVVDIEKSAEKFINNLTNKCTYIKEETVLPKNSIIYSKFMVLNELNNLQYGNKKLDIELKMKMYTDLFLEKKDNRKVTEKRILEYFRINGINDGKEKLTGLNNEIHADMKSYRDMCEIMGENFNINVAENIINWITVFHGEKKILINKIKNVYGKMFNDEQISKLSKLNYSDWGRLSKKLLTDIKCYIDADGINFPVSILEAMEVSNKNLMELLSNKYEFISCIDDINNKYFGDRDISASELIDELYVSPAVKRGIWQSVRILEEIVSIIGHNPKKIFIEMTRHNEEKVQKSSRRHNLEELYKAIRKDPEYVELIKEFDSTTDTDSFKIKKLYLYFMQLGKCAYSKEKIDFDKLFTDSYDIDHIYPRSKTKDDSIHNNLVLVKAKYNREKTDVYPIDINIQKNMNSFWNFLYTKKFITEEKYKRLIRTSDLTDEELAKFISRQLVETSQSTKATAEVLKQIYGDSDICYVKAENVSDFRYGSSRQKDKNDIQKLFVKCREVNHFHHAKDAYLNIVVGNVYDVKFTKNPVNFIKKNKMGNKSNYSLNHMFCFDVERNGYKAWDSSETIKTVGRMMKSNDVRITKHVHPTRGELYDATIYKAKIAKTGSYMPLKSSKNTPLSDVTKYGGYTKIKIAYYSVYKYKFSDKNLIKTEIRLIPIPIYLSKNDDDIKEYVKNYLNDRVNSKLIDFTKIYDKLYVNSLIKINGYLYYLGGKTNDRVWIDNAVSIVLDDKIEYLIKRISNDIKYGYEINVSDDELMDIYESLAEKANKKIFYNRLSDFEKIFSNMDVKKKFVKLEKNDKCRVLLQLLNVLTDSQTTYKLEMVGLKHSRSNIGMKISNLEEFKVINSSITGLYSNEIDILNI

SEQ ID NO: 985 - protein, 1196 aa, Dielma fastidiosa
MKEKYILGIDLGVGSIGWSCMAVNNENEPIRIIDLGSRIFSAENGSMEDRRNARGLRRLLRRRKARIQKTKNLFISNNYFTKDEMNLFFEKEACKYDNPYLLKVKGLNNKLTIEELLICLVHYSKYRGFKSNRKVKDEHSTNSTASASEDQKLLYSIQTTENELINNQWTISEYIVNDPKFKDKIKNTSGEYKIGITREMIVKEAELLLNKQIEMNVISDQFKNDYLTILTKQLSFSEGPEWGPYHDPLSKMIGICKFDKQDRAPITSYSYELYIMIQKLRNITFYEEGSRIKNRLNNEQIKKLLEEAVSGKEIKYKNIQKVIGHQVNFPGLLLTKKDFMKIVSKSKEEKNKDKTLEELKNEAKNNISVYEMKNTKILKSQLKKLGYENVEVKVLDALANLLSRYKSDDEIRKGIEEDELLKNQDQLFKAAILKLDEGSFKEFGKLSFNMLYQLLPLMINEGMDYAQAMAALNLDHSQAHKNDTDYEELPPLKEVFEELDKTVTNRSVIATLQQTKMVINAIFARYGKPVAIHVEVARELTKNDTERKQLMDMQLSNQVTNTSLKMQIFNKYSDQFTSMAKISHDDLVKYKLFIEQGGIDPYTLALTNDEMAAKINEKTLFTREYEIDHIMPYSISFNDTFANKTLVRKERNLEKANNIPYEVFGRDSGYAKYEAWVLRTINDPKKQEIYLLKKIPDDLQEEFSARALNDTRYATKVICEILKYCFPSIKVKSFTGQITDKLKGVWGLKNLTHSYQNPSYILHDEFDEELKKKYDLLSIYITEEKNNKEIKKLKEEVVKLEKQRDQKNRKNHLHHALDAAIIACATDSLRRRVEIHEQNLRQNSSTMRKFKVSVVDPATGEISTQIINRTVADYGQLYDLTKNSDPRHFPMPYDSFRDEIKLRLYERDEATMKRGLMCLANYNAAQVNQCKPVIISHQYTKKVNGRLHKATIYGVAPKPKTENTVVLTNRMAVTDKKFDYKQLDKIYDKEGTQKAVYEAVKSWLSGYANGEEAYNSHKELPKNSNGNPIKKVKLDYDSPKEEILLHEEKKQYVEKENVIQTHVFRREDSDKLYFIGMDRYRVMNFKNDPEVLIWWGQSKNNRKIKYSELAREGYIPYVKLYKNQIILLELRNGAKGLCKVNGFSAGMFEITSILGDDYDILASGLQTKSKSRLIITVSTIKSIQPINVDILGKVHL

SEQ ID NO: 986 - protein, 1367 aa, Peptoniphilus obesi
MKNQKDYYIGLDIGTSSVGWAVTDESYNILKFNSKKMWGVRLFEEAKTAEERRDQRAARRRLERKKERINLLQEFFAEEIAKVDPNFFLRLENSDLYREDKDEKLKSKYTLFNDKDFKDKDYHKKYPTIHHLIMDLIEDDSKKDIRLTYLACHYLLKNRGHFIFEGQKFDTKNSFENSINDLKTHLHDYYNLDIEFDNKDLIEVITDKTLNKTDKKKELKAIIGDTKFLKAISAIMIGSSQKLADLFEEGEEFDDSSVKSVDFSTSSFDDNYGDYEAALGEKIALLNILKAIYDSSILEKLLNEADKSKDGSKYISQAFIKKYNKHGSDLKQVKNLVKKYSPEDYNEIFRAENVNGNYVSYTKSNMTNSERKKALKFTNQEDFYKFMKKKLESIKEKINDPKSDDMLLVDTMLKDIDFNTFMPKLKSSDNGVIPYQLKVKELEKILENQSKYYDFLSSSDEYGSVAEKIVSIMKFRIPYYVGPLNPDSKYAWIKRDDKKVRPWNFEEVVDLDGSREEFIDRLIGRCSYLKEERVLPKSSLLYNEFMVLNELNNLKLNAIAISEEMKKIIFEELFKTKKKVTLKAVSNLIKKEFNLTGEILLSGTDGDFKQSLNSYIDFKNIIGEKVDRDDCQKKIEEIIKLIVLYGDDKAYLKKKIKASYKDDFTDDEIKKMASLNYKDWGRLSKKLLVGIEGVDTSTGEPGNIMHFMREYNLNLNEILSSRFTFVKEIQKLNPIHDRKLSYEMVDELYLSPPAKRMLWQSLRIVDEVEKILGHDPKKIFIEMTRSSQEKVRKESRKNQILKFYKDGKKAFIKEIGEDRYKYLLSQIEREKESKFRWDNLYLYYTQLGRCMYSLEPIDLSDLASSNIYDQDHIYPKSKIYDDSIENRVLVKKSLNHEKGNEYPISEKVLNKNCYAYWKMLYDKKLIGQKKYTRLTRRTPFSDGELVQFIERQIVETGQATKETANLLKTICKDSEIVYSKAGNVSRFRQEFDIIKCRSVNDLHHMHDAYLNIVVGNVYNTKFTKNPLNFVKNREKARSYNLENMFRYDVKRGDYTAWIAEDKENSKNPTIKKVKKEIRGTNYRFTRMSHIGRGGLYDQNLMRKGKGQIPQKENTKKSDIDKYGGYNKASSAYFALVEADGKKGREKTLETIPIIIDNKSRHGKIDAVSEYLEKDLGLKNPKILVDKIKINSLIKLDGFLYNIKGKTRNRISIAGSVQLILNKDDQKLIKRIDKFLAKKKDNKDIKVSIMDNIKEEDLIALYQTLSDKLNKGIYSYKKNNQAENIKEASGKFKELSIEDKIDVLSQLILIFQSFNSGCNLTPIGLSSKTGVVSILKKINFQEFKLINQSITGLFENEVDLLKLWLEEL

SEQ ID NO: 987 - protein, 1341 aa, Veillonella sp. CAG:933
MRFQNKKTGDYFVGLDIGTNSVGWAVTNEKYEILRAKNHRMWGSRLFEEGKTAEERRVHRAGRRRLNRRNDRLMILEDLFAEEISKVDKAFYQRLHESQYRQEHKTVSGPYFLFNDKEFTDEDYHIDYPTIYHLRVALMKAPAKDVRLLFLAIHHIIKYRGNFLHEGETFKTTGGLTDILQRVLACNEFSGLKQHIDDTALVKLLTNKGITRSDIAKQISELATDKLYRKQAKAFASLVLGLKANLDDLFNEPEYKELDSEIRTVEFSGKEYWEERDKYEPYLGESLFALDGCKTLYDTLLLSNIKPDGKYLSEAKVETFEKHHEHLESLKDLLKSNKALYNRVLRDDEKNLNNYITYIGKSEFNKRCSRDEFYKFLKQTIKDISDNENKAEIVQLMELDSFLPLLRVRENGVIPYQIHEEELEQILNVSSEKYPFLNKADGSGFTIAQKILKLLTFRIPYFVGPLNPAHKDRDNGFAWVVRKAPGKVYPWNFEDKVDISASATAFIENLTNKCTYLIGEDVLPKYSLAYSKFSLLNELNNLRYDGKPLSYETKQSFIKDCFEKEHRKMTEKRIREFLKHLGGTDGKGALTGLDVDIKSDLKSYRDMVRILGDGFDETMAERIIRYVTLFGEAKKVLLSTLEIEFGDDLSDTQKKQILKLQYRDWGRLSATLLKGIKGVAGDNPECSILECMEQQPLNLMEVLSSHNTYLAAIEEFNKERTEPTDIVDYKLVDDLYISPAVKRSVWQTLRILDEITKLRGSVPKKVFVEVARTNRAEKKKTDSRKERLLQLYKTIKDEGRNWTEEIKQRDAGDFNSKKLFLYYTQQGRCMYSGEKITSIGDLFTSKYDIDHIYPRSVTKDNSWDNLVLVKAELNREKKDIYPIEKDTQDRCISLWKQLLEQGLISERKYERLVRTTPLTADELADFVNRQLVETNQSVKAVTNLLKRLYPDTTICYVKAENVSDFRQEREFVKLRSLNAHHHAKDAYLNIVVGNVYHEKFTNNPRNFIKNARSDKKRPYSLNHMFDYLLQVGNKEIWNPKTDNNLVKKMMRNNDVQVTRMLVEQTGALYDATIYKASVTKSESYVPLKSSDAILSDVKKYGGFTSIKIAYYSIFRFYKKNSEEFETHIISIPVLKAGTLNSKEDYVAYGEEIMNKQKFDRVELVYKKLCMNSLVRINGVMYYLGGKTNNSLYIDSAISLVLPDNIAKKIKAVEKYIARVAENGNYKPQPDQVSPEFNMIIYKALTEKMKQPAFVGLKTNRENELEKETTITAFIAMTLIEQCKMLMEILNLLTQQKTTYALKPIGVSASRSTLGMNITGLSEFTIITQSVTGLQEKEIRII

SEQ ID NO: 988 - protein, 1387 aa, Peptostreptococcus anaerobius CAG:621
MSDSKKFEGENVKSGDKKTNKNHGKVLKSSPKEIRKNTEYFIGLDIGTSSVGWAVTNTDYEILKFNGKRMWGSRLFNEASTAEERRGHRVNRRRIQRRRDRLNLLEEIFSEEMAKVDPEFFMRLKESKFHLEDKDERILGESNIIFKGSEDGDKKYYEKYPTIYHLRHKLMQSCEDVDIRELYMALHHIIKYRGHFLFKGDFEETGTSIENIIIELLELINNNLGVKKFEYNESLINELKNIVSNTSNTITNKKKLLGEFFNKKEYKAHKSLFILSIGASVKPVDLFLEEEYKDIDDIKNISFKNLEYDQVRDTYESIFLDKIEFIDVAKRLYDATILLSIKPEGKTLSEAKVDIYNKHHNDLELLKKVLKTDKEKYDSILKLDIKKGNNYVNYVKKSKNGISCSKEEFHNALKKVLVKIEKTDDIKYILNEIELERFLPLQRVKDNSVIPYQIHRYELKKILENASKKFTFLNEESDGHTNIEKIIKIMEYRIPYYVGPLNDHHSVYNNGFAWVSRKRSGRITPWNFDEMVDKEESAERFIENLTNKCSYLIGEDVLPKESLLYSEFSLLNELNNIKYDGISLPIDIKKSIVEKIFRVEKKRVTKKYIKEFLKQEGYSDGKGEVSGIDIDIKSDLKSYRDMVKIFGTEIDYRMAENIIKWVTLFGDSKDLLKTKINKEYGEKVSKDQLKKVCKLKYRDWGRLSKKFLTGIRSSVLVNDATGEGYTIIEAMRNTDNNLMQLLRNEYDYLKKIDQINMLSRKDIDEISHDILDDLYCSPAVKRSLWQTIKIVEEIKKIMGHEPKKVFVEVTRTNKADKKTTITRKNRLLELYSAINAESRDWVNELNSTEVSKFNSKKLYLYYTQMGKCMYTGKNIDIESLFTDMYDIDHIFPRSKTKDNSFENLVLVTRKANADKRDVYPIDPKIQTERKSLWDMLHDKKLIGDKKYDRLTRTTGFTDDEMSGFIARQLVETSQASKAAAEMLKLINNDSEIVYVKAENVSDFRHENEFIKVREINDHHHAKDAYLNIVVGNVYNEKFTKNPANYIKKGGGNNYSLNCIFNRNLDRNGKRIWDEKKSIDTVNRMMKSNDVRVTFKNRVDKGPILNKVTIHKASEFMDDGKKNKKGFPIKSSEKNGNNRLCNLYKYGGYKDLNYSHYTIVRYNVYEKKGLDIKYYMIPIPYYLCLCNINQHDYVYDYISNRSKKDVNNIEIIVNELKMGSLINIDGYNYYLGGSKPKTFYVDPAYQIILDKEIERCIKEIVKAKNNEYRFINTDKINKNLNMKIYKYIVNKKIIGVFRNRKWDKGEYLNSSETIEKFSGLSVESQCNVILRLINDMRGSNKGGANSKFDELEMTISRAEIPQTLSNVSSFKIINQSITGLFENEVTIV

SEQ ID NO: 989 - protein, 1070 aa, Acetobacter sp. CAG:977
MAKDFEYILGLDLGETSIGWSVVRLNEGVPEHLERLGVRICSDGRDAQSHEPLSVARRIARGLRRRRDRYIHRRIRLTDVLVKYGLMPEDIKERKKLQALNPYRLRSEALDRKLEPYELGRVLFHINQRRGFKSNMKTDRKDSESGAMKQAILKTRAKMEASGARTLGEFLYFLNKDKTSTQEYVPVRMRSHSEKNKTVYEMYPDRAMYEDEVHKIFEQQELSPEAQTEIFNTIFFQRPLKPVELGFCEFEDGERRAYTASVVFQKFRALQQINQIYVQDDYERRPLTKEEKDILKHFLLEDFSALDKNGLLTWAKVRTLLKLQKKKFNLESERRKGLNADVTSWKLSNAACFGREWFSFSDAKKEEIVALITGAEKEEELIAELKTKYGLSDERAKNTANVSLPDGVASLSAKAMKKLIPFLEEGMLYDDAVKQAGYVFSSSFKGVLPEKYETFIEPESGECFDELPYYGQVLRRYVLGGVPSEENKLFPEKYYGKINNPTVHIVLNQLRKLINSLVAKYGHPRKIVVEMARDLKLSKKQKDAIAKEQALNERENKRIGAELERLDIRNNYDNRMKYKLWEDLSTDPTKRSCPFCGKQISQQDIFSPEFEIEHLIPFSRSFMDGRSNKVLSCRRCNREKGNKTPFEAFGNDSTRWNAIMGRVESLPENKRWKFASDAMSRFERDGDLLARMMTDTQYMARIARRYLCCAANPNQVYGIPGQLTAKLREHWGLNSILSDQKEKDRSDHRHHAIDAFVVACTDRGTLQKYSTERRDYAKPEMPSEKAPHIPFADFRLSDIKRVFDEIIVSHKPDRGNARAAILKGGTVAKLHEETYYGMGGEGSKKGTWKLIQRIPVSEIKKASDLDCLIDQKGTANPLRVLLVGASESEQEQIIASYFARRGTHKVRTYRERNKDVILPFKDKDGKLYRYAVYGSNAYAEIYCPDRGKNAGKWQVEIIPNYCAHQKGFIPKWRHTDAHAKLIMRLYRNDMVAYEKEGKTVIARVKKMGGNGVIVFRNHLIAKEEGDRLSWQAVVSGMQSANLRKIYVDVLGRVIDPKRPMTQNETDGQDN

SEQ ID NO: 990 - protein, 1353 aa, Roseburia sp. CAG:197
MAAFKYYLGLDMGTNSVGWAVTDPNYNLLKAKGKDLWGIREFNEASTAVERRTHRISRRRRQREQVRIGLLKDYFHDAIGEVDPDFFQRLANSKYHLEDKDTEVRYKNNVFNDDDYTDKDYFDQYPTIYHLRKELIESTDKHDVRLVFLALLNMFKHRGHFLNSGLGENSGENNINNAYLELTNLLSEFTQYNLNETIDGKKIEDILSRRDMSRTRKAEGLAEILGVDYKNKPYKELIRGLCGLKFNACAIFPEIQSDEVPKLDICLSEASFDEKSDEIANILGEDYFEIIMAMKDIYDIGSLAGIMKGHNYLSQARVTSYEKHKEDLRLLKNVIRKYCSKEDYDNFFNSEADGSYASYVGSYNSKTKQRRVGNKRSSEELYKAIKKILKNVPAEDADVQRILMSIENETFLPKQLTASNGVIPNQVHAKEIKKILSNAERYLPFLREKDETGLSVSEKIMKLFSFQIPYYVGPTTEKSSKDGGNGWVVRKEEGQVLPWNIDEKIDMKATSEAFISRMVRRCTYISGEPVLPKSSLEYQSFCVLNEINNIKIDGERISVELKQDIYKEVFQKGKRVTKKQLCKYLHTRGIIEAEEQVTGIDVTINNALTTYGKFKAILGDDISKDSVQKMVENIVFWCTVYGDSKKFLKDRIEEKYGEKLTKEQIKRIVGFKFKDWGNLSKNFLELSGADVSTGESVSIIRALWNNNLNLMELINSRLYNYKERLAEYQNTMMKTLSDIEAEDLDEYYFSAPVKRMIWQTILIIKELVKVLGCEPDRIFVEMTRRPDERKMRTESRRKKFEELYKKVKDEDVDWMKVIAHADETGSIRSKKMYLYLTQKGRCMYTGKHIELSDLFNNNLYDIDHVYPRHFVKDDNIDNNLVLVCKEKNAHKSDIYPLEDEILASQKNMWSELRRSGFITEEKYNRLIGRNSFTDEQKAGFIARQLVETSQGTKGVANILQQLLPESKIVYAKASNVSEFRNTRDIPKSRLINEFHHAHDAYLNIVVGNVYYVKFTQNPLNFIKNDYDRDKTKNNYNLSKMFDWDVERNGEVAWIAQKKDGEAGTIATVKKVLGRNTPLMTRYSFEGKGGLTNETLYSAKKAKEEGYIPFKSSDEKMKDVTKYGGFTSVTGAYFFLVEHTEKKKRSRMIESVPLYLAQKIEQNPHELEKYCEQVLGLIDFDIRVRKIKIGSLIKRKGYFFYITGKTGHRLILRNAVNMCLKKEWVKYISKLEKAVDKNNVEGIITKEKNELLYSELIEKFKNSIFSNRPNPVGDKLDEAKEKFINLDIEKQCIVLCQILQLSSVLGSECDMTLLGESAHCGKILISKKIGDEDIYLINQSVTGLYEKKINLRTV

SEQ ID NO: 991 - protein, 1433 aa, Bacteroides sp. 14(A)
MKKILGLDLGCNSIGWALVNEAENTEEISSIIKLGVRVNPLTVDEMQNFEKGKSITTNADRTLKRSMRRNLQRYKLRRDTLIEVLKEHGFITDSTLLSEHGNKTTFETYRLRAKAAVEEISLEKFARVLLMINKKRGYKSSRKAKGSEDGVLIDGMDVARKLYEEGLTPGELCLQILEAGKKNLPDFYRSDLQNEFDRIWNFQKQFNPELFCDAVKEEVRGKNRSQTWAILVKFFVWSEKEAVWNEKEARTEERVKEYKLVGLKRDTKGNELKLENYRWRVQALSEQLNPEIVAIVLQEINGQISASSGYLGAISDRSKQLYFNRQTVGQYLMSELEKDPNVSLRNRVFYRQDYLDEFDRIWEKQAEFHEELTVELKKEIRDIIIFYQRRLKSQKGLISFCEFEKREVVVEEDGRKKNKTVGCRVIPRSHPLFQEFKIWQTLNDIEVFAWDKQSKRKKADKSSILFDNSEDALLVEGKRFLYQEEKELLAKELFVKESMKKAEVLKLLFENYQELDLNFKQIDGNHTGFALFSAYSKMIEKYGYEPVDFKKSADEIIEKLETIFTNLGWNTELLSIDLSKEDKELERQSYFRLWHLLYSFEGDNTPTGNGKLLEKIMQLCDVEKEYAVELANVSFQEDYGSLSAKAIKKILPYLKEGNQYDVACDYAGYRHSKSSLTKDEIENKILKDKLEILPKNSLRNPVVEKILNQMVNLINTLIDTYGKPDEIRVELARELKKNAKEREELTKSIARNTREHDEIRQLLRTEFGMMNVSRNDIIRYKLYEELKDNGYKTLYSNEYIPREKIFSKEIDIEHVIPQARLFDDSLSNKTLEYRAINIEKGNKTAYDFVKEKYGNDGLEKFLNRCETLFKDKRTKLRKLKMEEKDIPEGFIDRDLRNTQYISKKAFAMLNEISRRVVATTGSITDKLREDWQLVDLMKELNLPKYEKLGMVEMFEDKDGRKIKKITDWTKRNDHRHHAVDALTVAFTKDVFIQFYNNKNAAWMPASKEHANITGIKARYFENGKALAPMPLAQFRAEAKRHLENLLVSIKAKNKVITSNVNRTKNKNGENRKLQQTPRGQLHLETVYGSHRQYATKIEKVNAAFDAAKIATVSKLAYRNALLKRLEAFGNDPKKAFTGKNTLEKNPLYLDENQTEMVPEKVQTVEFETVYTIRKPIDPNLSIDKVIDVKIRSVLEKRLKEYGGDAKKAFVNLDENPIWLNEAKGISIKRVSIRGISNAQSLHEKKDKDGNLILGKEGRKIPVDFVNTGNNHHVAIYKKPVLDKVGQIVLDEEGNPKYELDEVVVSFFDAVTRANLGQPIIDKDYRRIEGWQFLFSMKQNEYFVFPNEKTGFNPKEVDLLNPENYALISPNLFRVQKFAYKNYVFRHHLETTIKDTSSTLKGITWTDFRSSKGLDKIVKVRVDHIGQIVSIGEY

SEQ ID NO: 992 - protein, 1374 aa, Ruminococcus flavefaciens
MANDKTYLGLDIGTDSVGWAVTDGEYKLKKFRNNLMWGVHLFDEAQQSAERRSFRTARRRLDRRQQRIKLLQDFFAAEILKKDEKFFHRLKESSLLPEDSENRKKNTFFDDKNYGDKEYYKEYPTIHHLICELMDSNEPHDVRLVYYACAYLLAHRGHFLFNVNKDKIDRITEFKPIYTNFYNALIDIVETAPFDENADGMAEILKKHISVTNKDKELKELLFGGKVPKAEDESNIVIKYDQLTKIISGGTVKMSDLFCNEDYKELEKNSVCVKNADFSDTLDMLTGQVDELHLCLIASIKAMYDWSLLVEILAGNKMISISKVEIFDRHKSDLQELKYFVRTYLTKKEYDAIFREISDKSNYVSYVYNAPSENERNKYKKCSQEDFCKFLKTYLESIKPVYEDNERFEELLKKCQNGELCPKQVTTDNRVIPYQLYYAELKKILDNACNYLPFLNEKDEYGTVADKILSIMEFRIPYYTGPLVVSDKSKNAWIVRKAEGKIYPWNFKQIIDEDASENEFIRRMTCKCTYLAGEEVLPKYSLLYSKYTVLNEINNIKVNGVPITVEQKQKLYQDMFVSSNRKLTKKRIAEYFKSIGVYKGEIEISGVDDNIKSSLKSYHDFKQLLENGVLSENDVERIIERITVTTDTKRLKNWLEENFKHISNEDIKYISKLKYKDYGRLSRRFLEEILPIDDKTAEVLDEKNIISMLWESNNNLMELLSSNYGYSKAVEVSNKYYYALPENQKSISEQLKDMYIPTAVRRSVTRTIDIVKELKTILKKAPDKIFIEMARGEGETPKGKRAQSRRDLISQILDDADADNIPELKNKLDSIDDGKLRSEKYYLYFMQLGKCAYTGKAISFEDLEDNHKWNIDHIWPQAKIKDDSLDNKVLVDTNTNGAKGDSYPISSDIREKMQGFWHSLHKKGLMSEKKFSRLIRNTPFSEEELSGFIARQLVETRQSTKAVATLLKELFPDTDIVYVKAGLVSEFRHEMDMLKCREINDLHHAKDAYLNIVMGNVYDTKFTKSPLNFVQSGERYSMKLFKKDQNGKESGLLTGKVQRGDTIAWDPAVSFKTVRDMMAKNSIRYVKYTYKRKGGLFNQMPERKKEGLVPRKIGLDTSKYGGYNNTTASYFSIVKYNKNSIVIIPIETMYAKRFEIDIDFAMNYAADTLSSILSEVITADMVSMPMKNRALKINTLLEIDGFRCNIVQKSNKGRTLVIASSESLIVPPESYNYIKKICSFLEKSEKGKKYGVNSYSGINSDSNIELFDLLVRKMLSKPFNNILQKIGEKISKQRETFIGLDVTKQTIALYNIMMLMKTGRSTGCDLKAVNESGQAGVITMNSDLSKIKGKKIIRIIDQSPTGLYEKKSVNLFEL

SEQ ID NO: 993 - protein, 1170 aa, Aliiarcobacter faecis
MERILGLDLGTNSIGFALNKVEEKDSITIFNELASNSIIFSEYVPSTDRRAFRSGRRRNERASRRKENIRKLFCYFNLASKNILDNPIEYFNNLTKLYKEPYSLREEAIKGKKLSKDEFTFALYTIISRRGYTNLFAKEEDENKAKESEKINSAILNNKNIYKNSNYTLPSKVLTLKKEELEEDGFINIAIRNKKDNYNNSLDRKLWQEEAELLIESQKNNIELFKDIKTYEDFKNKFINGVNKNSKGIFEQRNLKSVEDMVGFCSFYNLYSKEPQKRVINAHIKAIEFVLRQRIENSILGNLILNKKTGEFVKISKEDIETTINFWLYTPNVQTITAKNIFKNAGLKDLEIQTSDKQDDTVQDISVHKALLEIVDFETILKNEEFYSKLLEVLHYFVSEQQIKDEIKKLNKENILSEEQIDKIANINKAKSSYLSFSLKFIDEILQKLKNDISYQTCLEELGYFKRYTQMEAYNYLPPLNPSIEDIKWLEKNVKNFKSEQLFYQPLISPNVKRVISILRRLVNELISKYGKIDKIIIETARELNSKKDEDKIKKSQEQSNKEIKDAQTLLKSGNKELSNKNILRARLLKEQKSKCLYSGEGLTLEEALDENITEIEHFIPRSKIWIDSYKNKILVLKKYNQNKSNQHPVSFLKSIGKWENFVGRVDEFIANKDKKICLTDEKNIQKIWDNEKLEDRFLNDTRSATKIVANYLEHYLFPKQNEYGKGESNDKVIRVTGKAINELKKLWGINEAQPKNEEGKKDRDTNYHHTIDAIVISLLNNSSKKALNDFFKQKEDKFKTKAILEKLKTRFPISKNGKSLFEFVKDKVEKYEKNELYVCPYMKKRENIRGFKDGNIKLIWDKELNNFSQIDKVEINKKLLLNNFGKDLKDDEVKKEFEKIKDKLNLPKQNNIKIALEEYEKRLLEIRKKINNISEEIKQEQNNLPRDKKAIETVEILEIKNRIEKLEQTKKEFVKELEFPCFFYTKDGKKQIVRSLNLKSNSVTKADSIIITDKKQKNRVQRLTKEVYENLKSSKTPFVAKLNDNTLSVDLYNTLKGQLIGLNYFSSIKNDILPKIDERKIKLISNYDDKITVSKNNIIEIEDLKNGTKNYYTCNGGGEIGKGKNVIKVDNINTKNKSVIPIQIADYRIVKPVKINFFGKISYEEFKKN

SEQ ID NO: 994 - protein, 1147 aa, Bifidobacterium thermophilum
MSDKTYRIGIDVGLYSVGLSAIQVNDDDDPVRILNAQSVIHDGGVDPNAQKSADSRRAQSGIARRTRRMRRNRKKRLKRLDQILVESGFPVSSENDLEGFEPWLLRAQAADAFIEDEDIRKRAISVSCRHIARHRGWRNPYLDVRTLLAVDSPSSAFYDKLVENAALEMDGQMPDSDATPAQIVRDVLEYKRGEAAIRLRKSTAENKKNRLALFPEKMMQDDYAYELRLILAKQAVPKDIARKLILAVFQSQSPKGSAEKRVGKDPLDPSQPRALKASLAFQEYRILNILTNLRLQDGGAERRLSIEEKQKLYKMLVEDTGREKKYETWTDIASAMEWKRNWLKGVGSLTADGDDRVTSRPPHIDIVEKLNGIKDTKFRKSILSWWKSATDVNREAMIALLSNTVDIAKKQDDPDFSSAVDFIDSMDDSDLQILDTISIQPGRAAYSSKTLRALSKRMYSTDDDLHDARKHVFGVDDSWRPPQPAIGAPLGNPSVDRVAKIVNRWLLACQSRWGNPLSIQIEHVRDALSSAATATADKRAYERALGKRNAEKMKVKNELRLQGLNEPHESDVRRQEAITRQQGKCLYCGDDITFSTCEMDHIVPRKGHGSTNTRDNLAAVCIQCNRQKSNTPFALWCQTPEAKSRGVSLEAAIHRVKGFFTESKELTGRQAKVFTSSMIMRLKQTTADDPIDSRSIESVAWMADELHRRIDWHFNGDASESDHGRRVLVAVYQGRITSEARNVMRFQAGGDFHFVGGHGKTRLDRRHHAVDASVIAMMTPAAALTLAERINLRDSQRCIGRIREGEIDWKQWPNEPTEKYQHWLDNGKRLFALINDALDNDRIPITHWQRYALGNSIAHEATIHPLRKIPLGSAIDYETISRAATPALYCALTRCPDYSVNDGLPENKQRHITVNGKVYGPEDEVAFFASDHVELAVQGGSADIGKTIHHARVYRCYFVDRRGQKKWFYGMIRVFRVDLIHARHENLFTYPLPSQSISMRYAETRTAEAVLCGHAEHVGNLVAGDEIEVPMIGKLTGKIDTFAKFFNESLNNEYVAERWSIDGFDSESKLLLRPLMLAEEGIANWEDNSHLSIPDDVKGLIARGWRPSVDTVFAKKPRIVRRNVLGEPRWKSRSGMPVSWRVTGSEA

SEQ ID NO: 995 - protein, 1424 aa, Prevotella sp. C561
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 996 - protein, 1034 aa, Helicobacter rodentium
MKINLQNWGQIMKILGFDIGVTSIGWAFVEGEELKDCGVRIFTKAENPKNGDSLAAPRREARSTRRRLARRKARLNTIKRLLCEEFGLNLSDYLANDGELPKAYETTKDTKSPYELRTLALEQKLEPKELARVILHIAKHRGYGNKHAKTGSDKDSGKVLSAIKVNEATMNAKRYKSVGEYLYKEFYQKERYEKKGNTLTKEFKNVRNKGENYEHCVAQEQVRAELELIFQKQKDFGATFSENFESQILETAFYQRDLKSFADKVGECVFYKGENRAPKDSLSAMEFVTLTRIINTLKNLEEKSKNLGIGETYGKDKIQEILKVVLDKGEMSYKKLREILHLDERILFAKDPKLDYTKGVQEAEKAKFIELKNLKTFKKAMGGDFGKFAREELDNIATEITLIKSKENLAKKLQNYPALSKEQVEALSNLNFAKHIDLSLKALHRILPFMYEGLRYDEAVQKAGLQEHKKHLQKGEFLIPLKEYEPYLANPVVARALSEYRKVLNALLRKYGAVHKIHLEFTREAKLSAKERQKYEKEQRGHFEANQNAIKQCEILGLPLNGANILKMKLWIEQGECCVYSGDKITESDLKDSNALQIDHIYPYSRSFDDSYMNKVLVFSKENQNKLNKTPYEAFGDDKEKWDRILSFSTKLPKQKQRRISNTNFKDKEGGFLARNLNDTGYIARLASQWSKDCLEFLPLSENEVNIAGEKGSKKHIEVISGSLTTTLRHYWGLGDKDRNNHLHHAVDAIILAYTNAKTIKAFADFRKNQEQNKAKFYAKQIAESEYEEQKAFHKAQVKVFRQRVEEKINEIFVSKPPKKRARGALHEETFYSFEDEKLLKSYGGKQGIEKAISLGKIRQVGTKIVSNGIMVRVDIFKDKKGKFYGVPIYTMDFALGILPNKAVAIGKDKEGVIKDWIEMDSNYDFCFSLFKDDLILVQKKEMKKAELCYFVSFGSANAQINVEKHNNKFEGLSENEKILYSNATQKEVAGKSIGIQNLKTFEKYQVSPLGEVQKAEFESRQEIKLKSSPKRKG

SEQ ID NO: 997 - protein, 1415 aa, Lachnobacterium bovis
MSRKEQEYFIGLDMGTSSVGWAVTDPQYKLLKFRGRDMWGMREFDEANGADSRRSYRIARRRHKRELFRLNFLKDQFREEIEKVDPNFFIRLENSKYHKEDKASVLKGSMNAIFDDKDFKDQDYFEKYPTIFHLRKALINDEVPYDEKYSRLVFLALHNMYKRRGNFLNTSLSDKGGEVSRPIAEIYKDLQMNCNELFGTAFPENVDADELQDILQDNSISKTAKKEKITELLGLNKKQKKEENIILLICGLAAKLKDFDENVEDSLKKETMKFSEENSDEKEENSDEKEEIWMKNLGEERYSCLMTVVKELYDSAVLNEILHGKDYISEARVESYDKHKKDLKLLKKAYHLYADEDTYEEMFRSEKDGTYCAYVNGYGVKGKSKKARRDYKKRSREELYKRIEKDLNLKKRLKADPLNEILTKIKNDIDIEAFLPKQLTAENGVIPNQIYVREMRKILSNAEKYLDFLKQEDISIESEEFKTVSDKIIAMFKFHIPYYVGPTTEKSKEFGGNGWVERKAEGKIYPWDIETKINMTKTRENFIQNLVRDCSYLCNEKVLPKHSLLYEKFSVLNEINSLKIKGKKIDSSLKQEIYNELFMHNAKVNKEKLVKYLINNGFMESKEELTGIDINIKSALTSYDKFCKVFGDDNMKKDSYRKAAEDAIYYCTIYGDSRKLLKDVLKKEVFGSKYGVEADDKQINRIIGFKFKDWARLSRKFLELEAANVEPGEARSLIGVMWETNMNLNEVLFSDKYNFREILEEKRRKEISTIQEFTFDDLSGMYFPNPVKRMIWQTVLVVKEIEHIMGHAPAKVFVEMTRSEDDKKERKDSRGKQLEELYKKIKDENKEWAEGQIDKIKEYDSNGMLKSKKLYLYYLQMGKDMYTGKPIDIEDLLSNNSKYDIDHIYPESVSDDSNISNNLVLVSKEMNNKKSDTYPIDENIRKKCYPLWKTLLEKELITQEKFYRLVRNTELTDEEMARFIARQLVETSQATKGVTELLKMLFKNQGTKIVYAKAKNVSRFRHDYGFPKSRLINDFHHAHDAYLNIVVGNVYYTKFTQNPLNYFAQKRKAEANGSKDNKDNLRKMFKWDVQRNGNIAWIAPTKFEPKKDEEGNDIPGTYNEYKPLDGTFMTVKKMLGRNTPILSRMCVTVSGGIADATITSHLKAEEGKYLPLKNSDSMFSDIKKYGGYKSISIAYFFAVEHMNKKMEKIRTIEVVPIYLEKKIESEERGLEKYCVDILKLSNPRILVKKIYKYALLKKDGYYFHITGKTNNSYYILNAVNLILPLNLVEYSKMLEKEKLSPKITYEKNVLLYNVLVEKYKETILALKPTPKVVKHITSSFEKFKDLDLEGQRKILMEILKFSSIGKQPADLSLIGGVKSAGIPTIGKEFSKSTEFKLINQSVTGLYQNEIDLLSI

SEQ ID NO: 998 - protein, 1418 aa, Lachnospira multipara
MQDYYLGLDVGTNSVGWAVTDEHYNLVKAPVKGKNKNHDMWGIRLFDTAETAKKRRTYRSSRRRLQRRKNRIALLQEIFKDEMAKVDDTFFIRLNESSLHKEDKSIQYKHPLFYKSEYTDKDYYRDYPTISHLRSELIHNPQEHDIRLVYLALHNIIKYRGNFLVENDYNENNNRDITEIFSEIVSAFDDYGISISCKDLSKLKEILTNDKLKKSDKSREIADLIIISAKKDEEEINEDKAIKAFSNLIVGKTGNVLELLYKIDKENVSKEDKTVFSINFSDSDYDYTQNENQTQREKLEDIIHDEIELIDIIKTLYDWKVFVGIMGDYTYISDAKKAQYDYHKENLKKTKYLFKTYLSEDEYKEFFHANKDESCTYSAYVGVSAKPKSSIKKCSEEKFYKQLNNKLLSIKDKIKEKDKDIYDTCLIGSDTEYCTLLPILRSKNNSTIPRQINELELKRILENASKYLPFLLEKDSKYNKTNIEKIISIFEYKIPYYVGPLSLRHVKDVNDRIKNGSNAWMIRKEGKENEYIYPWNFNDVVDKEKTNEQFIVRMTNKCTYLPQNDVLPKNSMLYQKFELLNMINNLKIRGNKINVELKQELYNKLFIGGKNIKFDTILNYLNNNYNMELDKNDLSGISEDFEFALTTEANFKKLFNKSSLTMQDKKIAEDIIRWKTIYGNDNALIMKVSKMNYPELSDEIIKNIGKMAKMKGWGNFSKEFLTSVYCEEMFSKKTGEQLSIINALWETNENLMQLLSNKYSYLDEINKINASVRGEITDFSYESCVENLYTSPQNKRAIWQTLLIIEEIVKVMGNAPSKIFVEMARGKDKNAKKTKSRKEQLKELFKNCKKDIENVDFDKLTNTLESKNNSDLRSKKLFLYYLQQGKCAYSGENIILDKLLSENSEWDIDHIYPQSKFDDNGLNNIVLVRKELNAKKSNELISQSIINKMKPTWKWWLDNKFISKEKYYRLTRTTEFSEEELSGFLARQIVETRQSTKIIADLIRQIYTSSKVIYVKAHLVSEFRQEPLNVLKCRAVNDYHHAKDAYLNIVVGDVYNTKYTDNPYKWMQKNKDSNYSITKTMFWDVKNIKGETVWVGCDKKDSVDGNGKSHKEFLKNDKGEIIGGDIERIREIVKKNTCFYTEYTYCDKGQLFNARLEKRNSGKLAIKKNLNISNYGGYTGIKPSYFALVEFAEKKKRKKQIIGVPIYVDNMLKHNENAFIEYCTNNLKLTNVVVLKQKIKMNSLLSMDGYPMRIRGDKGKENDFKNNLQLVLDEKHYEILRHVEKYQIKKSSLSKDEKKTIKINEKFDCIKGEDLISLYIVFLEKLKGPYKNRPANKYNLLEEKIDDFKGKSLEDKADVVFEIAKFFSSNATTSSDLKLLNAGSEVGRMTKTKNFVNNSKVKLINQSITGVYEYKERL

SEQ ID NO: 999 - protein, 1106 aa, Kandleria vitulina
MGRLVLGLDIGITSVGYGVIDIDNNVFVDYGVRLFKESDSENNVARRAHRGGRRLKRRRKNRLDDMKKLLFDAGILTKDYNPIKNIYEVRVKGLTEKLTNNELAAALLHITKNRGTTIEALESADADKEALGTKSVLAKNKEELREYEYICKVQLHRLKEYGNVRGTENNFKTIDYVKEARAILEYQGIDVELSDRILHIIQRRREYYEGPGSEKSPTKYGRWIEKGVEPIDLIEKMRGKCSIFHDELRAPKSSYSAELFNLLNDLNNISINGEKLTQEDKELVISEVNKIGEIKVNKLLKILNTKEEDVEGFRIDKNGKMLITDMKCYDQFKKIFDKNNEYAYRENKEIIDQIAEINTSKKGISERCEAIQKKFPAFDLNLVRDLAGMKGMTQYHSLSLKAIKIINDEMMKCPYNQMQVIHELGLQHYRKSYKGMKKIQADDEAILSPVAKRAQRETFKVINRLREIYGEFESIVVETTRDKNSAEKKKRIKNTQKYYEGRNKNVDKLLKEKGYDPALVNGKTKMKIKLYLDQDGKSAYTLVPLDLNLLISDPHAYEIDHIIPISISLDDSFNNKVLITHEENQIKGNRTPVFTYLNGLFKNCDLNTYKSAVKNNHNISRKKKHYMLYDKDITKYSNMKEFIARNLVDTSYANRVVLNTLTSYFKDNDISTNVHTIKGFATSLFRKRINLPKDREEDYLHHAIDALIIASVKKQPIFRDYLAKYNLDELYNKETGELIKVEDDDRVIDPVYIEFISNLKTIYEQSNQYYNGYISREEMKFKPIKISHKVDTKPNRQISDETIYSTRNVNGVERVVKKAKDIYDPKFAALTNDIINNQYHDKWIMAEKDEQTFEIIKSIVMEHFNTYKDDKDIYKSEVKKGVTVWSLKGSNNPLSHFKEEHGKVRKYSKKGNGPEITAMKYYEDKLGNYVDITSKYNVHDKNVVLLQISPYRTDFYLSPKGKYVFVTIRYSNVFYKESMKKYVIDEDWYENEKKRKKIDESYQFVCSLHHDELLGVKLKDGKAYIYDQSTEGDGIKRHHHGQYEILKFTATNNDKNNKIEVKPIYTYCKKQCMPSCGTFIKLTKFATDVLGNLYEVKDNVLKLEFD

SEQ ID NO: 1000 - protein, 1486 aa, Prevotella sp. HUN102
MKTILGLDLGTNSIGWAVVFVDDEGKFVQKIKLGSRIIPMSQDVLGKFDSGVTESQTAVRTGFRGVRRIRERNLQRRERLHRVLHTLGFLPKHYDSAIGWDRNRPTTYGKFLDHAEPKLAWEQQEDGSMRFLFMDSFCEMMADFARCQPHLIANGRRVPLDWTIYYLRKKALTQAITKEELAWILLNFNQKRGYYQLRGEEDEENPTKKEEYYELKVVSVEADENNKGKDTWYNVHLENGWIYRRSSKISLDNWVGKTKQFIVTTEYEKDGITLKTDKEGNVKRSFRAPKEDDWGLLKKQTEGQLEKSGKTVGAFIYDHILDNPSDKIRGKFVRTIERRYYKDELRAILTAQSKYHEELRDGTMLAACAEELYKGNLPHQQSLLKKDMSYLLLDDLLFYQRPLKSKKSLIADCPYEYYEYVDKESGEIKRQTIKCIAKSNPYFQEFRLWQFIINLRLFDRTDDKEVTEEYLPSKEAYARLFAYLNDRNDINQETLLKDFFKLKKEKMGNDKVYPIRWNYIEDTSKKYPCNETRHELLVALQRAGIDKEWLADKRLEYRLWHLLYSVEAKSEAETALQKLKDDEAFVNSFLKVKPFKKEYGAYSEKAIKKLLAVMRMGNDWNEDNICVDTRKRIEDIINGDIDEKIRSRMGQGMRSFESVSDFQGLPEWLACYVVYGRHSEATEIQRWETPEELLNYVRFGFKQHSLHNPIVEQCILESLRTVHDIWKEVGHIDEVHIELGREMKSTSAQRASRTQAILKNENTNLRIKSLLMELKNDAGIENVRPFSPMQQEILRIYEEGALLELTKEDKQFDEISKISQMAQPTANELTKYKLWLEQKYRSPYTGKQISLAKLFTSAYQIEHIIPQSRYFDDSFSNKVICESEVNLLKSNMLGYEFIKNHGGEIVHCTMLGDVKVFNEDEYKAFVTEHYSAQEAKRKKKNLLLEDIPDEFLNRQMNDSRYISKVVRTLLSNIVRTEDEMESTSKFVISCTGGITDRLKKDWGLNDVWNSIVYKRFERLNQITDTEAFGHWENKDGKRVFQTSVPLELQRGFNKKRIDHRHHAMDALVIACASRNIINYLNNESANSPEKREDLRRKLCDKNRIIRKPWETFTQDVRKALEDVVVSFKNYVRVINKATNYYEKYDESGKKIICKQKGEDMWAIRKPMHKDTVFGRVNLRRKETVVLSKALDNISSICNKELRKYINGLIAKNFNKKQLLAHFKSLNYRWNRQYVSKIDVWVNSDEKEPMVATRKPLDISFDKKRIESITDTGIQKILLNYLASKGDDPAMAFTPEGIAEMNKNISLYNNGKYHQPIMKVRLSEPLGAKFPIGQTGNKKEKYVEAQKGTNLYFAIYENDKGERSYNTVPLNEVAERLKQGLSPVPEVDDQGVPLKFYLSPNDLVYVPSEEEVALNECRMDKSRIYKVVSGTGKDCFFLPNRISKPIFEKVEFEAKNKLGRALSGEMIKTVCWKLEIDRLGNIRKIIK

SEQ ID NO: 1001 - protein, 1023 aa, Bryobacter aggregatus
MFIRKPEGYYVLGIDLGVASVGLALIETRFGEICHSSVRIFSEGMTGSEKDWENGKEVSNATVRREARGQRRQTERRKRRIKKVFHLLRSYDWLPDVSGPNIQDALNALDLELANRYGQHHNLPYFLRARGLDEKLSLTELGRAIYHLAQRRGFLSNRKLAPKKDDDMGKVYAGIDSLREEVSSSGKRTLGEYFASLDPEEQKIRGRYTYRDMYVQEFQHLWAAQQNHHPEELTAVRQATLFRALFFQRPLKDQSHLIGHCDLEEKEQRAPMYLLSVQRYRFLTALNNLRLAGPGAVSREISADERQAIIEKLGQCAKLSFTEIRKMLGVPKTFKFSIEEGGETKIPGNLTASLIYGVCPALWTGLDQASRDRLVDVLKRLESVESLDDRALALRNHWDVSDDEIDKLLSLKLPSEYASISLRAINRLLPLLEEGLTFAAAKHQLYPETDNCQVESFLPQVKDVFREIRNPAVLRSLSEMRKCVNAYIRHFGKPDEIHIELARDLRRSKGDRAAMTKEIRQNELARKKAYAALIENGIPNPSRWEVEKFLLWEECRRECPYSGKAISFHSLFVEQQFEVEHIIPYSRCLDDSRANRTLAHVEYNRIKGNRTPVEAFCGREDWPEMKGRFARFARTAKLRRFLMTETDAAELLKDFTERQLNDTKYASKLAAKYLARLYGGKSDETGMRVLSCAGKVTSALRRVWDMNRVLNVVPEKSRDDHRHHAVDAVAIALCSSKWIKALSDASAKTLHRRPLRSALLADPWPGFRDDLNQKIHEQTPVSHRPKRKLSAALHGDTIYSRPQIHNGKAVFHLRKPVFNLESEADIGKIVDPVIRECVREKFLEVGRDAKRLEHDVPRMRSGVPIRTVRVRQTSVSAVALGTGAAKRYVNLGGNHHMEMIAILDDDCKETGYEASVVSYLEANQRKRRAEPIVKRDHGLNRRFLFSLSAGDIVQYGRNGQTLGFWLVRGVTTDQKGRLDLCRLTDARIKSEQERERPTAAAFLKAKGRKVNIAPIGTWTYAND

SEQ ID NO: 1002 - protein, 1335 aa, Sharpea azabuensis
MAKNKDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGNDYKDNYNLFIEKDFNDKTYYDKYPTIYHLRKELCENKEKADPRLIYLALHHIVKYRGNFLYEGQSFTMDNSDIEERLNSAIEKFMSINEFDNRIVESDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYPKDTPVEEFYKYIKGLLAKVDTDEAREILERIDLEKFMLKQNSRTNGSIPYQMQKDEMIQIIDNQSVYYPQLKENRDKLISILEFRIPYYFGPLNAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADNEFGSKATVLFVLENSNKNLMEIINDEKLGYKQIIEESNMQDIEGPFKYDEVKKLAGSPAIKRGIWQALLVVREITKFMKHEPSHIYIEFAREEQEKVRKESKIAKLQKIYENLNLQTKEDQQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKDVKHHNNYGFILNSMNHLQSDIDTGEVMWDPAKIGKIKSCFYYKDVYVTKKLEQNSGTLFNVTVLPNDAHSEKGITAATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSPTEYVTARQLSLNEQSCKLISEIYAAMLKKRYEYLDEEEIFDLYLQLLQKMDTLYPAYKGIAKRFFDRAEDFKNIDVVEKCDVIKQILIIMHAGPMNGNIMYDDFKFTNRIGRFTHKNIDLNKTTFISTSVTGLFSKKYKL

SEQ ID NO: 1003 - protein, 1357 aa, Lachnospiraceae bacterium AC2029
MKKVGEYYLGLDIGTDSVGYATTDQRYNLLKYKGKPMWGSHLFDAANQCADRRGFRTARRRLDRRQQRVQLVDEIFAPEVSKVDPKFYTRRKASALYGKDRPDLTDANSCFNDKGYTDKEYHEEYPTIHHLIVDLMKNTEKKFDIRLINIAVDWLVAHRGHFLSDVGTNNIDRVLEFDSIYEEFISYFDGEGFERPWDSVDAGKFGEVLKEKGVNRKKLALKDLLYGGTIPSDEDYFIDRKELVNFLAGGKVHCNKLFRGYESEDDITMTISDDMEILLPQLGDYATIVGKMAAMYDWSVLSDILSSHAFISEAKVKVYEQHGEDLRRLKAFVKEYYPRKKYNEIFRESGKDCTNYTAYSYNLKSVGNGAELPKGKATREDFLKYLKQALDLDKITCRTEEDQQFVDELKERIAEGSFLPKQVNSDNRVIPYQLYYAELQKILDNASRHYDFLNAKDGDGYVAKEKLLSVFKFKIPYYVGPLKKEDDSPYAWIVKKADGPVRPWNFEEKVDLDKSESAFIDRMTNSCSYIPGENVLPKNSLLYTKYMVLNEINNIKVNGVAITVEAKQEIYEEVFCKNRKVTPKMIKGRLVTSGCIQKEDEISGIDVQVNASMKSRYDFRKLLSEKKLTEDDVEGIIARSTYTEDRYRYKKWLKENYPQFDEKELRDVAKLRYTDFGRLSRYFLSGLQGASKETGEVGTIMHFLWNTNENLMQLLSDRYTFVDEIEKLRNAYYAEHKMGINEQMENLGISNAVKRPVTRTLAVVDDVVSTIGHAPAKIFVEMARGEDEKKQRSVTRKDQILNYYRDVEEDTRLLEKQLEDMGDTANNRLQSDALFLYYMQLGKCMYSGEPIDLALIKTDKYNIDHIYPQSLVKDDSILNNRVLVLSKINGDKKDVYPIDKDIRVKMQPFWKHLCDAKLITKEKYDRLTRGSNFTDEEKMGFINRQLVETRQSMKAVTQILHNLYPESEIIYVKARLASDFKKVFDLAPKSRIINDLHHAKDAYLNVVAGNVYHEKFTKRWFKITDEYSMKTKVIFSKDLVRNGKTIWDHEHDLQTVRKSYAWNDIHLTRYAYCQKGGLFDQMPVKKGKGQVSLKDGMNIDMYGGYNKPTASFFTIAKYLKGGKKEVSFVPVDLMAGERFLKDEEFAREYVKKTLQEINTKKIDNVEFPCKNRVVRIKSTLLIDNVRVWVNGKSNGGKIILLTSAESAYFDRETTIYIGKIEKYAEKKKLNRNLRHDEQYDGLSCKNNIRLYNMIVDKLRKPPFSDMPGNQAQTLEDGKFLFEKCEFDIQIQTLLNCLNLLKSGRAGGCDLKAVGGKNSSGAMTLGANVSSGKYKRISIVNYSPAGLHVSTSDNILEM

SEQ ID NO: 1004 - protein, 1050 aa, Haemophilus sputorum
MKILGFDIGIASIGWAFVENGELKDCGVRIFTKAENPKTGDSLAMPRREARSVRRRLARRKGRLETLKRLLAKEWDLCYEDYIAADGELPKAFMGKNLNNPYVLRYEALQRLLSKEELVRVVLHIAKHRGYGNKNAKITKSEESKREQGKILSALATNASAIARYRTVGEYFYKEFCEVIKNPQGLSTNEHYTQSKVRVLKPIRNKGGEYTNCILQEDLQRELRCIFEYQKGFGFPITQEFQDKILKIAFYQRPLKDFSHLVGKCTFYPDEFRALKCSLSAVEFITLSKTINVLTYISKESGEVYSKGQYEQMLDSVFKAVCEKGSLSFAQLRKILHIDERIRFKEVDYMARKSKNTSGDSTHKQKTSNPETKKFIEHKNLKKFCEILSEIAEDRALADSIARDMTLIKDEEKLAQKLHGYGKFSQEQITQLSALNFSHHINLSLKALSEILPFMREGMRYDEACKLAGLKARHNDKKSKFLPPFCESIYADELTNPVVHRAIAEYRKILNALIAKYGSVHKIHIELTRDVGKNFQEREKYKKEIESNYKARVQAMQECEKLGLTLSEGNILKLRLFREQNEICVYSGRKITLANLKEQGALEIDHILPYSRSSDDSYMNKVLVFTNENQNKGNKTPYEAFGGDSQKWGEIESLALRSGYPKKKAKRILDKGFGDREAGFKSRNIVDSGYIARLIANYTKEYLKFLPLDSHENTALIAGEKDSKIHVEAVKGMLTATMRHFWGLGSKNRYEHTHHAVDAIIIAYINAAMIQRFSQFRQNQESLKARFYAKELAKEEFKTQRAFFEPFRGFREQVLAKVGQIFVSRPPRKRARGALHEETFYSIDDKKLSETYGGKEGVQRALSLGKIRQIGTKIVANGPMVRVDIFKHKQSRRFYAVPIYTMDFALGILPNKAVVSGKDTKSKVIKDWLEMDSCYEFCFSLFKDDLIEVQKSDMEKPELAYFVSLDASDGRIKVRHHCNDITKINENQKKLFSEAIEKEVVGRGSIQNLKVFKKYKVSPLGEIKEAKYEPRQPIALKTSPKKHRKQNNAQ

SEQ ID NO: 1005 - protein, 1174 aa, Lactobacillus mali
MGKYSIGLDIGISSVGWSIIDIEKKKIVDLGSRIFPSGNAAANQDRRGYRGTRRLIRRRKNRLADVINFLGEENFIDTKVVDQNGNIHYKLLVNSTESPYKLRVKGLSKMLTKQELVIALYHIVKHRGISYDLGDLEDDGTSGVTDYKTSININRQLLIKKTVGQIQLERLKEFGKVRGHVKKDENITLLNVFPSSAYVKEATQILTKQREFYPEITDDFITKFIPFISRKRDYFVGPGNEKSRTDYGIYKKDGRTLDNLFDELIGIDKISGEKRASASSVTAQIYNMLNDLNNLTVTNTEDGKLTTQTKREIIEADKTTNGLFGITQICKIIGCKKDDIKGFRIDKVEKPIMHTLSGYRRFRKELAKINIEANDLDINLVNKIADILTLNTEKAEIRKQLNKSNIDVSNEIKELIINKNKDFLVDGRATWHSFSYKTLNLLIPELMNTSEEQITILTRLGLVKSNSEKYKGLKNIPARRITEGIYNPVVAKATREAVNVFNAIAKKIGRDNISDVVIELPREDNEADIKKGIVKRQKQNELEKEAADALVKQQMTISDSALVAHYRKVRGLSQKVRYWYQQGTCCPYCGKNIEAVQLINNNDSFEVDHIIPISVSFDDSQNNKVLVHSQCNQAKGKQTPLGWLNNGGGFGQNKTEYVAKVKTNKNYSKNKMDNLLNDMDLSDIVTQRGFIQRNLNDTRYASRIVLDEFYSFFKSNNLSTKVKIVRGKWTSQMRKKWNGVGGLKKTRDTYHHHAIDASIIASFPLLKVFDKAIKLIDIDRETGEILQDKEAIKMSQEAKLLEKIPVIQNEKFEELINELYDFPLFKQVELANDITNPENPVKFSHHVDKKANRSVANQTIYGTRIKEKEINKRGKVEKVQERYILGTIKNIYDIDSFTSFKKIYDKMSKTGDVKFLMQKKDPKTWGKLVEILNSYPDSEEITQVDGKVKRVKVSPFELYRRENDFITKYAKHNDGPKIVSIKYYDSKIGSHIDITPINAKNKVVLQSLKPWRTDVYFNSETRQYELLGLKYSDLKFTNGVYGITSEAYEKLKHGISEDGTKTWKPIGKNSGFRFSLYRNNRVKIVDEKGESLELLFASRTTSNEGYVELKPIYKSKFDSKEDVGFYGQMTPSGQFVKKMARVGYKLYKVNTDVLGNPYYITKESDDPELSLYKK

SEQ ID NO: 1006 - protein, 1378 aa, Pediococcus inopinatus
MKNKDYSIGLDIGTSSIGFAVVDENNHVMRVKGKNAIGVRLFDEGKPAADRRAFRTTRRRLSRRRWRLKLLREIFDSYITPVDEAFFIRLKESNLSPKDSKKQYSGDILFNDRSDKDFYTKYPTIYHLRNALMTEHQRFDIREIYLAIHHIVKFRGHFLNATPANNFQVGKLDLDQKFEDLNDIYQRVFPDDSIEFRIDNLEQIKAVLLDSKRSRSDRQRSLVDDVYQTSEDKEVEKQNKAVATEVLKAILGNKAKLNIIANVEVDKEAAKEWTITFDSESIDDDLAKIDGQMTDDGRAIVEILRSLYSGITLSAIVPENHTLSQAMVAKYDLHKKHLTLLKKLINSMTDTKKAKNLRAAYDGYVDGVKGKVLTQDEFYKQIQSNLDESVEASEIQTYIDQDIFMPKQRTKANGSIPHQLQQQELDQIIENQKEYYPWLAELNPNPDKKRQQLAKYKLDELVTFRVPYYVGPMITAEAQKKQSGAEFAWMIRKESGNITPWNFDQKVDRMATANQFIKRMTTTDTYLLGEDVLPSQSLLYQRFEVLNELNKIRIDRKPISVELKQQIFNDLFKKFKNVTIKHLQDYLVAQGQYSKRPLIEGLADEKRFNSGLSTYNDFCGIFGAKLVDENDRQADLEKIIEWSTIFEDKKIYRAKLNDLAWLTDEQKDKLATKRYQGWGRLSSKLLIGLQNSEHRNIMDLLWIGNENFMQIQADSDFAKLIKDANQNALQNNDSQDVINDLYTSPQNKKAIRQILLVVHDIQNAMHGQAPTKIHVEFAKGEERNPRRSVQRQRQVEAAYEKASNELVGANVREELKDAITNKRDFKDRLFLYFMQGGVDMYSGEPINIDNLSRYDIDHILPQAFVKDDSLNNRVLTDAEKNRRKSDAVPNELFGAKMRVTWERMKEQGLISKGKYRNLTMNPENINKYTENGFINRQLVETRQVIKLAVNILADEYKENTQIISVKADLSHQMREDFELLKNRDVNDYHHAFDAYLAAFMGNYLLKRYPKLRSYFVYGDFKKFTQKEIKLRRFNFIYDLKHEDQVIDKETGEILWNKNEDIAYIRHLFAYKKILISHEVSERRGALYNQTVYKASDDKASGQGSKKLIPIKSDKPTEIYGGYTGRTLAYMTIVKVTKGKKISYKVVGVPTAVLAKMAGVRQGSQEEQDKLYGVLKPQFTHQKENKKTGEITETVDKFDIIVPKVKYQQLVNDNGQLFMIGSDTLPYNAEQLVLSKESVQTINNPGIKDEGSDEESENKKLDNVYDEIVLCMNKYFPLYDNRGFRNSITNGKNKFLKLPIKNIYKNGKLINVGKREVINRILQGLHANASVTDLSNLGIKSPFGFLQKGAGLSLSGEAQLIHQSATGLFEHRVQLNKIK

SEQ ID NO: 1007 - protein, 1357 aa, Pediococcus acidilactici
MGDRKYNLGLDIGTSSIGFAAVDENNQPIRVKGKTAIGVRLFEEGKTAADRRGFRTTRRRLSRRRWRINLLNGIFDAHLAEVDPTFLARLKESNRSNLDPKKSFQGSLLFPERKDYQFYKEYPTIYHLRKALMEKDRKFDIREIYLAVHHIIKYRGNFLNGTPMRSFKVENIELDTLFDRLNQLYEEIIPDNELAFDLEQVADVKEVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYKDHRHHLELLKKVIEDHSDAKKAKALKETYTAYVGKTDDKTQNKDDFYKAVEKNLDDSPEAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYEKFVVLNELNNLKINGRHLSLKDKQDIYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWHSTENFMQIQTRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDRLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIERDKKVVAPETGEILWSNVAPNETIKQIKKVYDYKFMLTSHETYTKHGALFNQTIYSAKASKTMIPIKNDRPTKLYGGYSGNEDAYMSIIRLSDKKKTYKVVGISMRDASKLKAYENNAHEEYLKKLKEVIEQQFLDSGKKTKADFEIVIPKVNYHQRMQDGTKQFRIGSSKYVHNTKQLVLSEKTLKAIRNNKQYNGDAEKDLINAFDEILTIVNDSFSIFDIRSFRKKLNESRDKFVSLPVEDTKEKSKVIKGKRETLKQILIALHANGTSQDIPQLGLKSFGKMVKTGGLTLSENTALIHQSPSGLFEHKIKLSDL

SEQ ID NO: 1008 - protein, 1375 aa, Pediococcus parvulus
MENKKYSIGLDIGTSSIGFAVVDENNRVMRVKGKNAIGVRLFSEGQPAADRRSFRTTRRRLSRRRWRLRLLREIFEPYINPVDEAFFMRLKESNLSPKDANKHYSGDILFNDQSDQKFYEKYPTIYHLRHALMTEHRKFDVREIYLAIHHIVKFRGHFLNAASASNFTVGKLNLEGKFDALNEIYQRVLTDDPFALRTDNLDHIKEILIDNKRSKADRQRTLTGDVYQSSEEKEIEKRNKAIATEILKAAVGNKAKLNVITNVEVDKEAAKDWSLTFDSETIDDELAKVDGQMTDDGREIIEILRSLYSGITLAAIVPENHTLSQSMVEKYNSHKAHLKLLKDLINNMTDTRKAKNLRAAYDGYIDGVKGKVLTRDDFYKQIQGNLDDSAEAQKIQDVMDQDEFMPKQRTKANGSIPHQLQQQELDQIVENQKEYYPWLAEENPNETRRGVAKYKLDELVTFRVPYYVGPMITAEDQEKQSGASFAWMKRKEPGNITPWNFDQKVDRMASANQFIKRMTTTDTYLLGEDVLPAQSLLYQRFEVLNELNKIRIDRKPISIELKQQIFNDLFKKFKNVTIKHLQEYLVATGGYDKRPRIDGLADEKRFNSGLSAYHDLHGILGAEVVDANDKQDDLEKIIEWSTIFEDKKIYRAKLDELTWLTDSQKEKLATKRYQGWGRLSKKLLSGLRNSDHRSILDILWITNENFMQIQADPDFAELVKNANQGMLGKNNSQDVINDLYTSPQNKKAIRQILLVVHDIQNAMHGQAPAKIHVEFARGEERNPRRSIQRQHQIEAAYDKVTSDLLVDAGVRQELKDAINDKRDFKDRLFLYFMQGGRDIYNGEPINIDRLSSYDIDHILPQAFVKDDSLNNRVLTDAEGNRRKSDAVPSELFGAKMRSTWELMREQGLISKAKYRNLTMNPENINAHTENGFINRQLVETRQVIKLAVNILADEYTEDTQIVSVKADLSHQMREDFELLKNRDVNDYHHAFDAYLAAFIGNYLLERYPKLQSYFVYGDFKKFSQKDTKMRRFNFIYDLKHSDQIADKNGKKIWHKTNDLDYIRHLFAYKKILISHEVSERRGALYNQTVYKASDDKASGQGSKKLIPIKANKPTEIYGGYTGKTLAYMAIVKVIKGKKIAYKVVGVPTSALVQLAGIEHGSQEELNRLYDVLKPQFTQLKKNNKTGEISETVSKFEIVIPRVKYQQLVEDDDKLFMIGSDTYPYNAQQLVLSEGALKVINNVYRKGENSDKQESYKLDDVYDEIIIAMKKYFPLYDNRGFREKVAEGKSTFENLPISNEFKNGKLTKIGKKEVINRMLQGLHANATMTDLKILGIKSPFGFMQQPTGIALSENAQLIYQSPTDLFERRVQLNKIK

SEQ ID NO: 1009 - protein, 1370 aa, Weissella kandleri
MEKNKEYVIGLDIGTGSVGWSAISTDNYQLIRQKGKNLIGVRLFNSAETAEERRGYRTTRRRLSRRRWRMSLLNDIFRPELNEIDENFLARLKYSWVSPLDQKNPQLNEQGTNASLYGDIEADQAFHRAYPTIYHLRKTLMEDNQKHDLREVYLAIHHIVKYRGHFLTPDFDANSQTIDIKGLFKQLGDVSGSIELQADQTSTVIAAFQSILLDFTKTPTESGRLAGQLFSDQNKDKQAKKQVEELFKLLRGGKGSLADMFLLTDLDKVVKNQLKFAFDDAVDENLNLISNLINEEQYELLLNIQKLRGTIILKQILGDDETVSDAKVRSYEEHAHQLKELKAQVLTKDNKEKFEEAYQLIQKGDASRIDGLKKLKTIINQEHEALRLDKYEADKLLKLIELDQLLPVQRSKRNGEIPHQLHEFELKKIIEKQGRYYPFLRETFERDGQEFNKIGQLVNFRIPYYVGPLVDPRLAGIQSGDQTNHWMTQKKAGKITPWNYTELIDIDKSAAEFIKRMTGTDTYLVGEPSLHKASLIYQDYNVLQELNNLRYDGKPLPVDAKQEIYSNLQVSLKNATKNKINSFLISEGYLQDGEELTGFAGKELKNKLSSFHYFKNIFGPERMNTLGTDNLEKITELQTVFEDRHMLKRQLQKLGFLDDDECEKLAGKHFTGWGNLSKKLLNTPAIIDPEINENKISLIDALYKGQRNLSFYVNNMDDKYQFRDWIESENQSQQVEISLDEKIKNLAGSPAIKRGITQSMAVIQDIIRANNGISPKRIYLEFARESQNSYQPNSRIKQIEKIYDQNKKELMKVYPDVFKDVQGVLNNVDENNSLSEKAFLYFMQLGKDMYTGEALDFDKLYTYDIDHIIPQAMTKDNSWDNKVLVTAIKNREKSNQVLDNAIQAKMHNFWLQLKKVNLLSQRKYDTLMKTNFSKGDEKKFIARSLVETRQIIKNVAELIKSEFDHVEAIPIRQELTSDMRQLMDYKKNRLVNDYHHAHDALLIATVGEFMQKRGFMQGMNPSQNVYHGYTQYVKKWLSMAKKARSAEKPERIFPLQFVVGSMRMAVRDGQVDKVTHPATGEICWTADNEAYLRKVLGYKNILVTRKVKNAGKLYQRVTVKPKGSGEAPVNHQKSDINIYGGVTSEQAAELVLIRIKAKNNAKNMVIKIPTAIANQVANKTTTYDAYVRSLNIPNYAGIILDQIPLGQLVFDERTSFYLASAEIKHNARQLWVNQHINNVLTKKNINDEERDNILNLLTNEKNLERFKLLEPDLKRVKAAKQQWASCDDQEQMQILRIIINKMHDDASPQIPGKIDPFKNYLDKQGKGWRDLRTKKGMKLSDNAEFVYQSPTGLYHRKISINELLKQKQLE

SEQ ID NO: 1010 - protein, 1379 aa, Pediococcus stilesii
MRIDNGLEELKVNNRIYNIGLDIGTSSVGFAVTDAQDKLVRVKGKTAIGVRLFEEGHTAAERRGFRTTRRRLSRRKWRINLLNQIFEPYISEIDPTFFARLKNSSLAGKDKKFEGSLLFPDRTDYQFYKDNPTMYHLRKHLMEKDRQFDLREIYLAMHHIIKYRGNFLNTTPMNHFKNEEIDFSALFSRLNELYQEIDDENIFELNIENVDEIKKILLNHDLFKMEKQKQVAKLLNVDTDDKQLKKENTALASNFSKAILGYKFNLALVTKIPDQDKKEWTISLGDEDFDDRLDNVPVALTESQLEVVEVLHSIFNSISLNEIVENGETLSSAMVRKYNDHKHDLKLLKNVMTTLEDRKKAKKIQGIYNVFVGKDTDLISDKDKNKYKDKDEFYKEIQKNLDNSSDAEEIIKRIKQDQFLPKQRTSKNGVIPHQLHQRELDLIIENQAKYYPFLKEANPNKKRLKQAKYKLDELIAFKIPYYIGPTSGAENSDFSWLKRKKDGQITPWNFDEKVDRIESANRFIRRMTTKDTYLLAEDVLPLESLIYEKYSVLNELNNVRINRQKLSVNDKQDIYNELFKNSKTVTLKQLQKYFEVTKKLKTVVVEGLADPKKFLSNLGTYHDFKLIFGDIVDDPEYQTDLENIIEWSTIFEDRGIFNSKLNEITWLTDEQRKKVLSKRYQGWGRFSKKLLVGLKNSQGNSILDELWNTNLNFMQLQSQDDFAELIHAENAKQFKANDPDNPWNGIDAILNDAYTSPQNKKAIRQVVKVVQDIEKAMGNKPQKIAIEFTRSADKNPRRTDSRIKRLSDIYKEAAEKVVGESLKLELNEYLTSKKKMTDKMYLYFTQLGTDIYTGKKIDIDQLNNYDIDHVLPQSFLKDDSLDNRVLTNRSDNSEKSDTVPLHKFGAKMGNFWRQLADEGLITKRKYKNLTTDPATIDKYTIQGFIRRQLVETSQVIKLTANILGGLYPEETEILEIPAKLNHQFRDMFDLVKVREVNDYHHAFDAYITVFVGNFLYRRYPKLRSYFVYGDFKKLNKTDDDIRKFNFLNLFNKDKVEDNETDEILWSKAESIRDIKNIYNYKFMLVSREVYTRHGAMFNQTIYPASKNDSKKLIPIKKGKDTAIYGGYSGNTDAYMAIVAVEDKKGEKFKVVGVPTRAVSRLEQLAADDHDQYLTALHDVLKPNFTKIKTNRKTKAKEEVTTPFRILVGKVGYRQLIQDGQVKMMLGSSAYKYNAKQLVLSEKSLKVIKNNKKYNPDDENQDLIDVYDEILGVVNRAFNLYDTNGFRKKLNDNRVKFVELPINNIFDGTKLVQMGKRAVLTQILNGLHANAALGDLKALGISTPFGKMQSKSGIPLSMDASLVYQSPTGLFERKLNLSDL

SEQ ID NO: 1011 - protein, 1395 aa, Lactobacillus ceti; identical to SEQ ID NO: 165

SEQ ID NO: 1012 - protein, 1346 aa, Lactobacillus saniviri
MVEHYAIGFDIGTGSTGFAGVDPNGKLVRMRGKNVYGVYRFKGGEAAADRRGFRTTRRRIKRRKWRLRFLKSFFEPYIAPIDPEFFLRQKYSADSPLDPKGIRADKGLLSDMSDQEFHAKYPTIYHLRYQLMHEKRQFDVREIYLAMHHIIKYRGHFLIEDGADNFDAKQIDFFDQFQRMAAVTAGLPELETLVVPDETQSDAFKRVLFDESQTKSDRQKVLASQLLDIQDNQSKAIKDFIAALTKAVVGMKANLATLTSTAIESTDKNDWTKPLGQLDDFLLKHEEDLDEDGYALIDAANQMYSAAVLAALVPEGMGFSEAMMARYAQHKKQLALYKQVIASLPDKTQRHELKDAYADYIEHAAQNPRDAFYKRVTKVLEGVDSADARTVMTAISHDEFLLKQRTLSNGKIPYQMQQHEFDAIIENQKAYYPWLATPNPVEADAKRLPYYLDELIGFRVPYYVGPMVTEKQSQFAWMIRKADGELTPWNFFDVVDREKTANRFIQRMQTTDKYILGEDVLPKHSILYQQFEVLNELNNIRVEKHPLTTEQKQFIYQRLFVDQQRKTITKKNLQDTLVAMGEFDKAPDIGGLAKEDVMMSSLATFADYSKILPEAISDPTRQNDIEDIIAWSTIFEDTQIFFDKLKTVDWLTTQQRKRLASIRYTGWGKLSKRLLQQIPTSKHTNVMAALWATSDNFMQILQDEQFQEGLYDANRLPEETLTPDEQVEKILDEAYLSPADKKGARKVIKVMNDIVRANHGVLPEQVFLESADDPQKNKRRSVSRSKQLEEKYRQAAQSFIDEAVKEELNAQIVNSAEFNDRLVLYFTQNGRDMYTGKRLDIENLGSYQIDHILPQSLVKDDSLDNRALTARDINAEMSNQFVSERFGLGPRAFWQQLKNNGLISGRKFRNLVMQRDEIDKYAPGFINRQLVETRQIIKTVEQIIHRLWPDIQIVTIKANLTHQVRSELGFPKVRELNDYHHAFDALLAARIGQYLLEHYAGLKPFFTYGEFKRGDTKKYGTTNFLRRLTKDNKDKKGELLPEVSDWIDSIDSIYNYKKIPVVWENTTNMSALFDQTIYPRPDRDTTKRKLIPTKLDKPTDIYGGYSSAKTAYMAVMRVQTKKGTEYPVFNIPVSIASQLNRITDQTMLKQQVKQFIINAEQSASKKKLYESGDVILSRVALGQRFTDKNYGEVFLISNMEVQNPQSLWLGRASQQRLTREPEGNEKPETSLADIYQQILKQVDRYFLAFNIRQQRQKLLGTLDQFTSLPVGRVNEQTRTDQNQRSIIARVMIVLGKGSREEKFPEFGLSALGRLVRTGGITLSEDAQIIYQSPTGLFERRVALKDL

SEQ ID NO: 1013 - protein, 1361 aa, Sulfurospirillum sp. SCADC
MTSLISLDLGGKNTGFFSFTAKDVSIIDTFQSGTIIYDESFVLSQVARRGKRHGKRNNLRNTLVKRLFLLLLQKHYGLSLDFLPDEILGLFNKRGYTYASFEIKEDEKENLESDILKEFLNDKLNYTIQNDDEVEEFLNQIASNEETFKNYKKDFENLFGASTHQPKKQIELIDEIKKDLEKEDAKELLDGLKVIKKIIDEFHKQQNQGNLPRAKYFEELYLEIEYNLKIQKFFTCNHLHINDMQYLIGNLSNYQLKELRRYFNDEAMAKEDFWSCEKLHRITWRFIQSWHPKSPEDKQRQKENLANLKTKSIIEFLTTTNPLMTIPPYDDMNNRGAVKCQTLRLNEEYLDKHLPHWRAIAHTLASETQKENLEGVTVKGYSEDSTLLHRILDTSSIIDPYRLRSDEIDSYCDVLTKDNAFALKKFAKEYYQLVKEKVRTGIWTKDDDMFKKCDHNPPHKNNQIHNLVAGILGKPIAKERFEAFENELWNVKFGNKKLSSYCKNIEEFRKSNGNLFKQIVELGEDKEVQKYQKELNEWVRKIGEFFNIETPYRARFNNLFSMAQLHTIIDTTRSGFNATCKWCSCENQYRASTRIEIDEQTGEITTNANCQRLPADTQRPFSGKIERYIDKLGYEIAKVKAKELEGIKEDTIDLKIILEQNAFAYEESIRNAKIKNANAKAKKALEEAQKRGLKNIEDKTKRIKDFSNSICPYCGQSLGEDGEIDHILSRSYTLKKYDTVFNSEGNLLYVHQKCNQAKLAKTDYSLQDLKIDISQKWIEEQIATIKTYKTFSVLTQEQQKAFKYALFLDNSNEAYQKVISWLRTDQSSRVNGTQKYLAKKIQEKLKAMFPAKTFNFEFILADANDVHDLRIKAYQLPEKPKDSKQETYSHTIDAVMSLVSVWDKVLPKTEKPTKEDILKFANVENWSALNNEFLTKGKSANQKIEEMIQANDFGQKNMRQVFSKPIFKDESIGERYKPFVRYHNQFYIGYPISIKDGYDMQHCQAMISKNDISRVEEILKDTSLCTLLKEKNGIKLYSINKQSINELSNQFFNLNYQNLNDAQKKKSELAEFVINHCKYYVKKTSVINAPQFIDKDSMKPYPFYKDWQKFHEAYKKELDAEPKTKKDNGKLVYDISGIDDFWTEFCKKYFGIKTKDNRNKARKVFSIVALTSAPGTVFRIKRKTPKGHIYQATAIDNQQISGDYANVLLAGNSKTLALAGQKPSSDLKKELSVKESKDIRDIKLEPSRFFKEGFDCRGIEVIVNKTSATIKNFPLTKIDKKIKKLIFKTLFEKKDGKRQKQKTSISLKEKNTMQETLKKLLKDSIKVTIRDGSISGIEISKKTVNFTLPFKSENLAKLLDD

SEQ ID NO: 1014 - protein, 1347 aa, Lachnospiraceae bacterium MA2020
MGDKKNHSRKEFEDYYLGLDIGTDSVGWCVTDKDYNVLKFNGKAMWGVRLFAKAATAAKRRSFRTARRRLQRRRNRVLLVEELLSEEVAKVDPLFFTRLKESKFYLEDKDEKVRQPYCLFADQNYTDVQYHKDYRTIYHLRNALMEHDRNYDIRLYYLAISNFMKHRGHFFFNGDISEVTLFEAVFDSLKEYLVNEFEVSLETDDIEEVKNVLLDKKIGRADKKRKLIDLFDAKKSQIKSEILGAICGLNVSLDKLFDDESLKDAGIDKISFYDGIDDEKNDELLEVLSDRFEMMIRLKAVYDWSVLANILADSTSISKAQIKVYEKHKKDLQDLKYVVKKYVPNEYDEIFKDSGVKENYTSYVAHVFEKGNTLTEKRITEQSDFCKYIKKKLEKVDAEDEVLARIKTEVKNYIFMPKQISKNNSVIPYQVHLQELKKIVDNMGIDYPLLKEKDTDGLSVCDKILKIFEFRIPYYVGPLNDYHSENGGNSWVIRKESGRVLPWNFDSKVDIKASARAFMSNLTNKCTYLLDEDVLPKDSLLYSKYMLLNELNNIRINGDRLDVDVKQRIYNEIFKTRSGKFSLKKLTDWLVKENIASREDKVSGIDKVFQTTLKSYQDFYRILGSRVETEPQFIDKLIENILIFGNDKRMLKELLTDEYSDRLSTEEIESISKLKYSGWGRFSSKLLNGIEDIDKETGEIKTIINFMWNGNENFMELMSSKHGFAEKIRQQNDEFKGNSAEISYDLVYDSYASPAVKRGIWQTLLIVKEIMKVKGKSPKRIFVEVAREKEKNPKRKETRKERLLAPYKSIECERRNWYDEINKRKDWEFDDTKLYLYYTQLGRDMYSDEEIPLEELFTGKYSKEHIYPQSKTKDDSIINNLVLVRTDYNNERQDKMPIPEKFRQPQLWTRLKKLNLISEEKYKRLMRKEDFSDEELTGFIARQLVETRQSTKIVAQILEQTLPETKVVYSKAINVSDFRYMDKKYKLVKTRSINDFHHAKDAYLSIVVGNVYYTKFTDNPKNFIAGKKEYNLKKLFDHDVTRNGEIAWKQGEEGTIATVRKYMAKNNILFTRYATENRGKLFEQPSKKNSKNLTPLKLSDSRMNVKKYGGYSGLGYQYFSVVEHEKNMKNKKAVRALVAVPEYLGDSHEAFIEYCERVLKFNSPRVVYEKIKIDSFLKIDGYPVHLACNKDLTRFVAKNAVQLCLNRESEAVIHNIEKVIKKKDENKDYKITSYDKISEEEVISIYDILLDKLKNGIFSNMKGVSADKIEVAREKFMLLSIDDKCEVIRQLLFVFKCDRKNANLAVIGIGGDIGEIRYNKNLSDYKSFKLVSQSVTGLFENEIDLLK

SEQ ID NO: 1015 - protein, 1108 aa, Carnobacterium funditum
MIFRRDRMGYRIGLDIGIASIGYSILKTDENGNPKKIEFLNSVIFPIAENPKDGSSLAAPRREKRGLRRRNRRKNFRKYRTKRLFIESELLTEKGIRTIFENIADKSIYQLRSEALDKLLTNEELFRVFYFFSGHRGFKSNRKAELKDSDNGPVLTAISETKKALHTTGYRTLGEYYYKDSKFDEHKRNKEHEYLTTPERSLLVEEIKEIISKQRGYGNEKLTEKFEEAFIGNQSDKGIFNQQRDFDEGPGENSPYAGDQIEKMIGWCTFEKEEKRAPKASYTFQYFDLLSTVNNLRIQEYAGESYRNLIVEERQLLIDKAFEKEKITYKDVKKLLNLDEYAKFNLLNYGSKIEAEATEKKTTFVSLKAYHKLKKTVGKEVFSEMSPVVIDEFAYILTAFSSDNSRMREFKNRLDLSNELVETLLSITFSKFGNLSIKAMKKVIPYLELGDTYDKACGEAGYDFRQNHINEEYIKENVANPVVKRAVSKTIKVVKQIISKYGPPDAINIELARELGKSNEERNKIKKRQDENRSYNEKVASQISELGFAVNGESIIRLKLWFEQKNLDPYTGLSIPLDDVFSYKYDVDHIIPYSKSFDDQFTNKVLTSTACNREKGNRIPMEYLGNNPIRVKSLEAVANQIKNIKKREKLLKQTFSKEDTDGFKERNLKDTQYISKLLKSYFEQNIIFSESLEQKQKVFVGNGVVTARLRARWGLNKVRDDGDKHHAMDATVVACMTPTLIRMLTLYSRRQEVRANLDLWQTYDEKEDPDFLKLSKIKREQYESLFSKRFPEPWPGFRDELLIRMSEDPKSLIKNYPTVKANYSEQEIMDLKPMFVVRLANHKITGPAHQETIRSAKLLDEGKTVSRMSVDKLKLDKNGEIKTAKWEFYQPSDNGWKIVYEAIRRELEKNDGDGTKAFPEKEFTYEFNGHSHTVRKVQVVQKTTLSVQLNDGEQVADNGSMVRIDVFKTAKKYVFVPIYVSDTIKNELPNKACVAHKPYKDWPEVDEAEFQFSLYPRDMLHIKHKTGFTAFYNGENKGPSKISDFYGYFTAADIANAQINIVSHDNSFLGKGIGIAGLEKIEKYAVDYFGNYHKVNEKVRQAFQRKKG

SEQ ID NO: 1016 - protein, 1107 aa, Carnobacterium gallinarum
MFRSGDMGYRIGLDIGITSIGYAILKTDNTGNPYKIEQMNSIIFPAAEHPKTGKSLALPRREQRGARRRNRRRKFRKYRTKMLFIKHHLLTKNQMEMIYTDSRILTDIYELRKKALDERISNEELYQILYFFAGHRGFKSNRKSELTEKDMGTMLTAIKGIEEVLRNGTYRTLGEYMYMDAKYQEHKRNKEGLDRYLGTAKRALVEDEIKQILTKQFELGNLDLTKEFEEAFIGDEEKTGIFNDQRDFEDGPGKQSPYAGNQVEKMIGDCTFEKDEKRAPKASFTFQYFDLLSKINQLRYRERIGSDYQELTSEQRELLKEKVLTTQKVTFAGVKKLLGLSPYTQFNLLNYGTKTTQEETESKTNFYSLLNYHKLKKTLPETFFKSLSVDQIDVIAYVLTVYSSDHRRRDEFYGRLALPEEIVDLLLPLNFSKFGNLSLTAMKKIIPYLETGKVYSEAAGLAGYDFRYKQIDEEYIEKNVNNPVVKRAVKQAIKLVKNIERQYGYPPDALNIELAREMGKTFADRRKVMKFQEEGRRRNEQLAERIRDLGQSVNGENITRLKLYEEQNGFDPYTGNTIPCNQIFSDVYDVDHIIPYSKTLDDSFGNKVLVSSAANKEKGNRIPMDYIGGNPERRKKLETIANSIKNPKKREKLLKEELTKEDMEGWKARNLNDTRYISKLLYDYFRQTIQFPELAVEKKKRVFAINGSVTAKLRARWGFNKVRANGDEHHALDALVVACVTDKYIQEVTKYSKRKEVRENSDLWRLDETPEAIEADVVKTKTDYNRIFNQAFPTPWVNFREETRCRMSGNPSELMKNYTWETYTDEEIADLKPIFIVRLPKMKTKGAAHEETLRSGKLYEQGLNISRVSVSRLKLDKNGVIKSGNAEFYQADGNGWKLVHEKLTEALLAHGGDGSKAFPEGFLQYTHEGKEYMVRKVRVVGKSSLQVPLNTKLAVADNGSMIRIDIFRTENGKYQFVPIYVSDKVKETLPNQASAGGKNSKDWPVVKPEDFLFSLYPNDLIRIKHKKGVKHTSKDGNKEVEIKSDFFAYYKGANISTASISGINHNNFFEFEGVGLATLISLEKYRVDYFGNYYKVNEKIRQEFHKK

SEQ ID NO: 1017 - protein, 1436 aa, Flavobacterium sp. 83
MAKILGLDLGTNSIGWAIVDKEGTEFSLLDKGVRIFSEGVNIEAKTNSESSKAAQRTGYRSARKLKYRRKVRKIDLLKILSDNNLCPKLSDEELSDWRYKKIYPQNDEFRKWLSTDNQDNEQERKEQKYNPYYFRFISVRNSLNLNNKEDRYNIGRAFYHIAQRRGFLSNRLDSSDNSIIEEKKFDITSLINESHSIVEFSEIFSDFLSSFDKDEAIDKPLFTLSRAFNAIIKDNSKSVYDDLKEKLIERLNKKEFLGPVKRAISDLSEKIENSGCSTLGEYFYTLYEKGGKIRGEYTHREDHYLKEFETICKTQNISNELKDKIEKAIFFQRPLKSQKGLVAKCPLENRKACVPISHPDYEEFRLYSYLNNIKIKTPNDDKLRVLNADEREQIDFLFYRKSKANFDFLEIAKKLTPKNLKSGYYKDKNSKEYDILFNYNLGSNVAGCPTIANLREVFGKDWKEYLYSNFLKNTKTEKNKIVQKTVEDIIDDVWHILFRFDKEELLKQFAIDNLSCDDKTAIKFSKIKLKQEYGSLSLKAIRNILPYLKQNLIYSHSVFLANMKNILPAEIWNNEENKRVINNEINSILENYKVYSNNIEIVNGLIKNIKKENGTWSSDNKFVAEVYKKDLEKQVKDFFGTKKWNETPIEYQTAILTECFELFSSQMQLKSGRAEFAKKKTIDEILKQFLNDNFNVDAEGLKKLYHPSAIEVYKKAKRSEEDGKLYLGSPLISSIKNPMAMRSLHQLKKVVNQLIKDDLIDEETVIHIEMPRELNSANERVSIRQWQEELKNKRNKYAEEIKSIFRGDIKMDGCNDVISIEYEPTENDILKYQLWIEQHKICLYTGKTICLSDFIGSNPKFDIEHTIPRSRSLDNSQINKTLCCSIYNREVKKDKIPFECSNHKEILLRINHWFAKYKTLEEQIKDLSKKVKVASTKERRDKYIIDRTKLRFEHSYLYKKYKSFTMEEVPEGFKNSQSVDIGIISKYGNLFLKTAFSKVYPIKGKTTANLRQMWGLDEKTRDNHAHHAKDAVVVACCTRDINDALANYYHDLEQYEFYGKPKPSFAHRIPWKGFNNDVKEFDNSILISHHTPDVLSTQSKKAIRKRGIIQRNEKGEIKYKQGDTVRGALHKESFYGAILREELDKKTGKTEEVVKYVKRQAIGLFKDTDLKNIVDDKVREIVERGREHEKQIKKEIEELKKVMKNINEEEEQQFKDAIELLENRIKNELYILPNSKGSPVPIKKIRYFTNDVSNPLLIKKHRDVSRHEHKQHYFAKNDGNYCFAIYDGKDKKGKIITEYKVVNNFEAGKYYNSNANTHKFPLEFNIEDKNKNILELKFLLKTGTLVLFYKNFKDEIWELDNLDLAKRLYKTVAIEADGRIQFRLHSTSKPDGQLEKSSIIDFEVANEKLRISKSSLTVLVEGFDFNISSTGKVIKI

SEQ ID NO: 1018 - protein, 1455 aa, Salegentibacter sp. Hel_I_6
MKRILGLDLGTNSIGWSLIEQDFNKKEGQILGMGTRIIPMSQDILGKFDSGNSISQTAERTSYRGMRRLNERYLLRRQRLHRVLNILGFLPDHYAASIDFHNKLGQFLPGKEVKLNYILNGGSKHHFIFQNSFDEMAKDFKIKHPDLKIPYDWTLYYLRKKALKDKISKEELAWLILNFNQKRGYYQLRGEEEEIEKNQEYVSLTVKELINTGEAVKGKPLYKVIFKNGWEYDREITKIEDWEKQEREFIVTTKTNKDGSLKRTFKKVDSEQDWIAIKKKTEQNIDETNKTVGEFIYETLLKKPSQKIRGNLVKTIDRKYYKNELIKILEVQKEFHPELENKDLYKKCLNELYPRNEAHQSNIKEKDFTYLFVEDIIFYQRPLKTKKSTISNCAYEKRYFQKDGEIQEQPLKGIPKSNPFYQEFRLWQFIQNLRIYKKIALDKQKAKIDEDITNHLLPDTKSIVELFDFLNNRKEIDQNQLLKYFSDLKLIPKQKKDAPSYRWNYVEDKKYPCNTTRAEFLTRLKKLKGIQENFFDKKTENDLWHIVYSVKDKKDFEKALGTFARKKRISESKFVENFKKIAPYSNDYGAYSEKAIKKLLPLMRMGKYWNEESLKPEIKNRIEDIQERLRAINFNKDEIETVADDAYKKQVLKSFLKSENKKNPFEGLNTYQACYAVYERHSEVSEIINWQSPSDIEFYLNETFKQHQLKNPIVEQVVTETLRVVRDIWKYYGNSKADFFSEIHVELGREMKNSAEKRQRLSNQNNERENTNLRIKAVLEELQDEGVEEVKPYSPNQQEILKLYEEGVYFNAKYDQVSEDEIEAIRKKNSPTKKDILRYKLWLEQGYRSPYTGNIIPMSKLFTTDYQIEHIIPQSRFFDDSFNNKVICESAINPYPYKDNQTAYEFINNSRGCVVPELGINGKECTIFTVEEYEAHCKSYYSKNRTKLKYLLSEDIPEGFINRQLNDSRYISKFIKGLLSNILREPNEREATVKNLVPVNGAITSQLKQDWGLNDKWNEIIAPRFKRMNEITKSNDYGYWDNKINAFRTQVPKDIETGFSKKRIDHRHHALDALVIACTTKDHINYITSINTERKNHSLVKKLRKTKDIELGGKKRTVAKSYKQPWEGFTIDAKNALEEIVISFKKNIRVINRTNNKTWHWEKKNGQWKKALKFQKGNNFAIRKPLHKETVSGLIDIPTPKGKVATATRTNISDIKNHKHIDKITDKSIQKILRNHVKNYLDQNGKEDFAEAFSPKGITDLNQNIKELNSGKNHQPIYKVRQYEVGNKFSVGERGNKTDKYVEAAKGTNLFFAVYWDDKKKKRNFETIPLNEVLEHQKQMAHIPMKDKEPIPIDHTKGKFLFFLSPNDLVYIPDREDIDSDVIPENLKKEKIYKMVSSTGIQCFFIKHQVSTVIQNKVEYSALNKMEKDIEDNMIKNICWKLEIDRLGNIKKIVK

SEQ ID NO: 1019 - protein, 1123 aa, Flavobacterium daejeonense
MAKILGLDLGTNSIGWALIDDVQNKILGVGSRIFPMGVENLGDGDGEISKNASRTGTRGVRRQFFRRRLRKKVLLKALSENNMCPMITSDFDNWKKTKQFPSEKLASWFALNPYELRNKALSEKLTLEEIGRIFYHLIQRRGFLSNSRKGGTDDGAIFKGNPKEGKIGITDTQESIQDKTLGSYLFEIYPKENQPFQNGLERIRNRYTVRKMYVDEFEMIWEKQAQYYSNLNEDLKTLFGGRKLDGYKEDGILFHQRPLRSQKHLVGNCVFEPNKTKCPISAIPFEQFRVWQWVNTVEYNGKKISQVEKEKIVEFLYANDKTDFKKIRKAIGKESTEFKFNYKDDDKIVGTYTVSHLSNKKYFGKKWFEFSEKEQEDIWHILYFFDSKSNLKEYAIKNWNFTEEQAESIAKFNVKDGYSSLSRKAISNILPFLKLGFTYDVAVVLGGIKNVFGHEWEKLSDEKRNFLIDNVEGIVRSKTKGGFIDVIKDILRNDYNISDNQLRKLYHHSATIYVAELLEKLPVGKEADKEIQSIRNPIVITALFELRKLVNELIDDFGSIDEIKVEMARDLKISKSQRNKIRREQKRLERENDRVKARLLEEGQRITHDNILLYKLWEECKKTCPYTGNPIPLYKLFTGEIQIEHIHPWSRSLNDSFANKTLCYADENRKKGDKTPYEFYGNDESNWSAIKERALKLFSDTKEYPNAYQKFKRFVQHKFDDDFSSRQLNDTRYISKEAKNYLSKICKKVAVSPGQATSNLRQKWGMNNILNDENEKTREDHRHHAIDALVMACTKISYVQELSKWNRYNRNAELKKFPLPWETFWSDANRAVDKILISHKKVSNDITGRTHISEKNGKKYKNVGVAARGQLHKETVYGKRTFNGEEAFHVRKTIDSLTTEKQLEKVVDESIKLLIKKRVQELGGFVKGAIPANTFFVVDENGIKQPQIFLPNKNGAPVPVLKVRMKENIGGAEKLKENVNQWVNPRNNHHVLIYKDEKGNLKEEVVTFWTVVERKRTGQSAYQLPFDGKEIVTTLHINDMFLLGLNEEEINWENPDYEVLKEHLYRVQKFTSGDYYFRIAKTSSIQNAIEKQQINSFGFGKNGWSTHNPIKVKISVSGKISKV

SEQ ID NO: 1020 - protein, 1439 aa, Empedobacter falsenii
MTKTILGLDLGTNSIGWALVQQDFENKQGEILGMGSRIIPMSQDILGEFGRGNSISQTAERTGYRGVRRLRERHLLRRERLHRTLNILGFLPKHYANEIDFTKRFGKFINHAEPKLPYKNGDFLFKKSFLEMLEDFKSNQPEFLKDKNGNNCLVPYDWTIYYLRKKALSQKIEKEELAWLILNFNQKRGYYQLRGEDFAEEKDKLFVKLKVDKVVDSGEKIKGNILHDVYFDNGWKYDRQIVKTEDWVGKTKEFIVTESCLKNGDIKRTYKAVDSEKDWIAIKSKTEQDIDNSNKTVGTYIYENLLLNPKQKIKGKLVRTIERKFYKEELNQILRKQQEFHSELQNEELLQDCVRELYKHNEQHQQMLESKDFVHLFLNDIIFYQRPLRSQKSSISNCTLEKRISKEGVVFSIKVISKSNPYYQEFRLLQWLQNLEIYRNEDDTKVTTEFITSVEDKEALFDFLNSKKEVEQKHVIDFLLKQKSNKNKLPKGEAEKYRWNYVQDKKYPMNETRYLIQSKLDKVEDVPNDFLSFENEMALWHIIYSVNDKIEYEKALAKFALKHQLDEASFVESFKKFPPFKSDYGSFSEKAIKKLLPLMRFGNQWNYDAIDNISKERIYKIITGEYDEKIKNRVREKAEQFNLTTENNFQNLPLWLAQYVAYGRHSEAEITGKWNSVSDLENYLKEFKQHSLRNPIVEQVITETLRVVKDIWQEYGKGAQDFFSEIHIELGREMKNTADERKRLTNVVTENENTNLRIKALLAELALDATVENVRPYSPMQQDILKIYEEGVLNAEENIEEDILKISKTAQPSSSDLKRYKLWLEQRYRSPYTGQMIPLNKLFSHEYEIEHIIPQSLFFDDSLSNKIICESAVNKLKDNRIGLAFIKAYHGEVVPLGNGKTVKILEVQDYEDFVKQNYSKNRTKRNKLLMEDIPEKMIERQLNDTRYISKYISHLLSNIVRDVTPDSKDDGINSINVLPGNGKITTRLKQDWGLNDVWNELILPRFERMNELTNSTDFTSTNTNGKVIPTVPIELSKGFSKKRIDHRHHAMDALVIACATRDHVNLLNNESAKSETKRYDLNRKLRVYEKVTYKDQKTGEQITREVPKDFLKPWTQFTIEAKNALENIVVSFKQNTRVINKATNYYESYKDENGNLRFDKNGKPKKDFVEQKGMNWAVRKPLHKETVSGQVHLDRVKVAKGKILSATRKSLDTTFNEKTIQSITDTGIQKILLNYLKAKGSPEVAFSPEGIEEMNKTISLYNEGKNHQPILKVRVFEQGSKFPLGETGNKTKKFVEAAKGTNLFFGIYEDKAGKRSYNTIPLNLVIERQKQGLSPVSEINDKGHRLLFHLSPNDLVVIPKDGDINSKDVYKVVSFTGGRLYVIPHFVSSVIVNKIEYTQLNKIELTKEKDLIKKIEFDRLGNLISKSSKLEELFYKRRM

SEQ ID NO: 1021 - protein, 1130 aa, Pseudomonas aeruginosa
MKYRLGIDLGTASLGVVAVEMQNDEPRQIAWHALRLFKEPLDDSPKGLQPRSGERRTARLQRRQVERRARRLRRIAHLLTLLGPEWKDRCRMNVRHLTEKRAHAARLRIEPWELGCVLLRMAKRRGYSGGFRASESAAGMVKTASERLQQAMSLLAAERGLDRITLGEYLWYRQENGLPVHLKASRPSLAESDPLYALREMLEHEFQQIWETQAKYHSALNGDYLGRPLKAWFYDALFYQRPLKSIAGMVGNCLLEPNLPRAPKAHPAAQWFRIEKSLHDLRWGGGRRAPRLSRAQLDLLRELLGQPGNADARVSFKQMLAALDEAGLGDALGRSLNLENGGRDGLIGHRTLTTWRKLGLKDQWLALAPGLQTTLINLLADLGSPEVLDQEGWHLKVPRANTKPGDPNPYRKFAPELVRFVDQLREQCNDKGQRVYDRFTTMGFEAGRSSYSIKALERLNAWFADPWWPDEGPGAERRGEVDEEAALRVCYPHLFQPAPARLDELKAAPETGSAVVDVALRQLRRVINQCIAALGSPPQEVIIEMGREVGRGVEWRNEQARRMRENEKVRRKIADSLAAHGLSASSGRVLRYQLWLEQGEQWCPYCNHPISLEAATCGMTHAEHILPRALTQVGRKRSELVLAHASCNDLKGERTPWQAFGSDPQRWAAVERAAAQFEAQGRKLYARDRAKAQGLYRKARLLLLKDYEQDVLSDESLAGFADRQMHQTSWIARVAAQWVKSITPLVSVSRGEMTALLRHQWRLETVIPEVRLDEGFSVLDTERQPVTAEDFARFRRQWEGHPSSHGDERTERRLEKRLDHRHHVIDALVVALTSRSLYMKLARHYREEGERRARGESRRRDWGIAPPMPHLRDQALAMIRGCNLSHKPDRNASGGLFKDKPYGVTRPSEGAVQRLTRRKNLLELADEKSVSATYTAIVSIASEEVRKLVLDTFEARLSAGQSIKEALSCPVDYPRYRTQIWRVRCLTPYKADNVKRITHRSRGGEHHKYLLHAGYACLEIAPIEHEIGCDAKVKRKPAFSTRLITMVEATQPGFNMPAPGVRRLFKGDTVRNSEDGRIYVVAYFQENGRKISLVPFCETRNYGNMKKDGDKNKREIAFSKAVCLELLPDG

SEQ ID NO: 1022 - protein, 1386 aa, Psychroserpens sp. Hel_I_66
MKRILGLDLGTTSIGWALVEESKNKEESNIIKLGVRVNPLTVDEKINFEGGKPITTNADRTLKRGARRNLDRYQLRRDFLIHELKKQNFITENTPLTEIGKDTTHQTIALRALAARKKVSLEDLSKILLGINKKRGYKSSRKSKDENDGVAIDGMVVAKILYDNKLMPGQYVFNLLTQEKKHIPDFYPSDLKTEFDAIWTKQKEYYPEILTQILYQDLKGKNKGQTWTICSKPFQIEGIKLEGNRNEQKIKRYELRKDGLSKKLSLEHLAIVFQEINNDIKGTSGYLGKISDRSKELYIDKLTVGEYLYNQIKKNPHTSLKNQVFYRQDYLDEFEQIWNTQAEFHPELSDELKAKIRDIIIFYQRPLKSQKGLLSFCLFESWQQEYFDEVKQTKRKRTIGQRVIPKSSPLFQEFKIWQNINNLEFKYFGNPKDGSDKDAASFKLDEEDRKLLFLEANLRGDLNETSVLKLLGLSTKEWKTNFKEGIKGNTTNEKLFNVYQEIATREGYGIDWKENSATEILEELKAVFPSIGIDASLLEFDGTLQGNTYSKQTSYELWHLLYSAGDDTVISEEDKLIYGNSDVSLKKKLHQKYGFEPVYAAMLANISFPNDYGNLSARAIRKILPYLQDGFNYYEACDKAGYNHSNSITSEENKKRELKERLEILGKNSLRNPVVEKILNQMIHVVNQICDTYGKPDEIRIELARDLKKSAKERLETTKYINSATKINLDIAKTIQQQFGFTPTKNDIVKYKLWNELAPRGHKSLFSDEQIKLQDLFSSKIDIEHILPKALIYDDSFSNKTLAYRHVNLKKANRTAIDFITQDKNTELENYIERVEGLYDKGKGPISRGKRDRLLKSAKDIKEGFIERDLRNSQYIAKKSRTMLLEVFKEVTPTTGRITDRLREDWGIINVLKELNLPKYRAIGLIEIEERKNDKKIEKIKDWTKRNDHRHHAMDALAVAFTTHNHIQYINNLNARRDETHDKHKTIQNIETLITQKFEDDKGNYKRKFIKPMPKFRSEAKRHLEDILVSFKTKNKVVTRNLNKTKKDGGFNTALELTPRGQLHEATIYGKSKAPKQKPTKINKNFSIGEVQQIIHFGQRELVLKHLSQFENDPKKAFDTKTLKNQPLAWNDEPLNEVLCFEDIFTIRKDVSPGLNIDKVVDLGIREILKQRKAKHNGNEKEAFSDLDKKPIWQNKGKGIAIKRVTITGVSNAEPLHYKNDHVGEVLLDELDKKIPVDYVSLGNNHHVAIYEDDKGKLQEKVVSLYEAVERVNQNLPIIAKGYNAHLNWKFKFTMKQNEMFIFPSKEFNLNEIDLINGINSSMISQCLFRVQSISTKDYRFRHHLETSSDNNLDFTYQRIRSPERLRDLIKVRLNHLGQIVQIGEY

SEQ ID NO: 1023 - protein, 1081 aa, Unknown
  NCBI_JUNU01000017:138543138_7
MTAFKPNPLNYILGLDIGIASVGWAMVEIDNEENPIRLIDLGVRVFERAEVPKTGDSLAAARRAARSIRRLTRRRAHRLLRARRLLKHEGVLKPEDFDENGFIKLLPNTPWQLRAAALDRRLAPLEWAAVLLHLVKHRGYLSQRKNEGETADKELGALLKGVADNAHALQAGDFRTPAELALNKFEKESGHIRNQRGDYSHTFSRKDLQAELVLLFEKQKEFGNPHVSDDLKNGIENLLMTQRPALSGDAIQKMLGHCTFEPAEPKAAKNTYTAERFIWLTKLNNLRILNQGNERPLTDAERTTLMDEPYKKSKLTYAQARKLLDLDDTAFFKGLRYGKDNAESATLMEMKAYHAISRALEKEGLKDKKSPLSISPELQDEIGTAFSLFKTDEDITGRLKGCLQSEILDALLKHISFDKFVQISLKALRRIVPLMEQGKRYDEACAEIYGDHHGRKNSEETLYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKVIDIRRLNEKGYVEIDHALPFSRTWDDSFNNKVLVLGSENQNKGNRTPYEYFNGKDNSREWLEFKARVETSRFPHSKKQRVLLQKFDEEGFKERNLNDTRYVNRFLCQFVADHMQLTGKGKRRVFASNGQITNLLRGFWGLHKVRAENDRHHALDAVVVACSTVAMQQRITRFVRYKEMNAFDGKTVDKETGEVLHQKTHFPQPWEFFTQEVMIRVFDKPDGEPEFEEADTPEKLRALLAEKLPSRPEAIHEYVMPLFVSRAPNRKMSGQGHMETVKSAKRLNEGISVLRVPLTQLKLKDLEKMVNREREPKVYAGLKARLEAHKDDPAKAFAEPFYKHDKAGNPTQQVKAVRIEQVQKTGVLVRNRNGVADNATMVRVDVFEKAGKYYLVPIYSWQVAKGILPDRAVVAYADEENWTVMDESFEFRFALYSNDLIKVQLKKDSFLGYFSGLDRATGAISLREHDLEKSKGKDGMHRIGVKTALSFQKYQIDELGKEIRPCRLKKRPPVR

SEQ ID NO: 1024 - protein, 1391 aa, Staphylococcus pasteuri
MTNKTWYLGLDIGTASVGWTATDTEYKIIRKNKKRLWGVRLFEEATTAEERRGYRSSRRRLARKKSRLNLLEELFTQEIAKIDANFFLRLKESQYHYEDKTHQVPYAIFNDKHYTDKDYYKEYPTIYHLRTKLMTEENPDIRKVFLAIHHILKNRGHFLLQGQSFKDGNLNNLIKELLDLDILHIGFDVTEEVASKIATISLEKKTLTDKVNDLKKLYPKEKQLLEVFRLIFGGKTSLDKLFVIDEYKELDASVKSVSFKEKIYEEVRHDYEQVLSNYIELLDLAKLVYDSIILSDIKKEGKTLSESKVDLYNKHRDDLTKLKNLVKNDSKLSEDKKVELYSVIFKEDKDKGTNYVNYIRKSEEGKGCNYEDFKKFLVKELAKLEESTAKDEILRDLELELFLPLQRTKDNSVVPYQIHKEELVKILDNAAKYHSFLDEKDESGYSIREKVIQLLEFRIPYYVGPLNSSKKAKEDGFAWSVRNKGYENTPVTPWNYEKVIDESASAEKFITNLTNKCTYLKGEDVLPKSSLLYSEFALLNELNALKYDGNRISLEARNVIIEKLFKQQGKKVTKTSIKNLLKAEGYIDGKGEITGIDITVKNDLKSYRDFKKILGDKFNTKHVEDIILWITLYGESRKLIKAKIEAVYGDIYSKEEIAKMSRLVYKDWGRFSRKLLTELVSKKLYNEETGECLNIIGSMRQNNILFMELLADRFDYSQQIIDYNKELQKEVTEITPEILDDLYVSPSVKRSIWQTVRIVEELKKIIGCAPTKIFVETTRSNQEKKKPTDSRKKQLELFYKAVKKDVKELEKEIGSLNFDKLNERLSSVEPSKLKAKKLYLYYTQLGRCMYSGETIDITQLNTTAYDIDHIYPQSKVKDDSFTNTVLVKREYNAAKTDRYPLGSDIQTPSNRKFWKFLKEKGLITDEKYNRLVRTEEFSDEELTGFIARQLVETSQSVKAVASILGELNPETSICYSKAENVSSFRQNFGKIKDGNRKSENTEQLIKVREINDYHHAKDAYLNVVVGNVYDTKFTRNVFNFIKDKKDGRKYSLNNVFYENVSNSNTVAWEMNKTVHQVEKVMNNNNILVTRRTSEQKGGLFNATVYKAKVASKAKEGVYYPLKTSNNVIKDVTKYGGYTSIGIAYYSIFEYILVNKKGEEKITRIIPIPIYISQNIKDDSTLLEFGKTQINIKSNEEIKDFKLKYKKLCIGSIIFINNYPYYIGGKSGDTFYYDNAVQVILDKESEKYIKNISKYQNWKKENKDGELWESITKEKNIKLYNTLVEKMNSGIFTKKKPNKFEELNIDEVRNNFNNVSLDDQAKVLLEILNLLTNKKSIFDLKLINIALGRSRYNFNITSQSQFSIVEQSVTGFYEKEITIIGDKENDMENNNS

SEQ ID NO: 1025 - protein, 1338 aa, Lactobacillus salivarius
MERYHIGLDIGTSSIGWAVTGDDFKIKRKKGKNLIGTRLFKEGNTAAERRGFRTQRRRLNRRKWRLKLLEEIFDPYMAEVDEYFFARLKDSNLSPKDSNKKYLGSLLFPDISDSNFYDKYPTIYHLRRDLMEKDEKFDLREIYLAIHHIVKYRGNFLENVPAKNYKNSGASIGFLLEEVNNLYKDIVGDENVTILNSEKFEDVEKIILDDGIRNLDKQKGVGKLLVEDKKNKNLVTAFSKAIFGYKFNIEDLLLVEGDEKSKLTFNDENIDDIFNELSHSLDDRRMDLLTKTREIYFKFKLNMIVPTGYTLSESMIEKYEIHKAHLKMYKEFINTLNSKDRKILKNAYTDYINNEKAKAANAQENFYKTVKKTIKDNDSDIVKKIIDLIDEGNFMPKQRTGENGVIPHQLHQIELDRIIENQAKYYPWLAEENPVEKNRKFAKYKLDELVTFRVPYYVGPLVDKTESNKNEKETKFAWMVRKSKGTITPWNFENLVDRTESANRFIKRMTSKDTYIIGEDVLPASSLLYEKFKVLNELNNIKVNEKKLDIEQKQNIYLKLFTTTKNVTKKNLATFLNCSIESISGLSDDKKFNSSLSSYIDLKVILGDIVDDYSKNEDLEKIIEYSTIFEDSNIYKEKLSEILWLTDDQIEKLSNIHFKGWGRLSKRLLMQVTNDNGERIIDALWNTSNNFMQIVNDESIQSELAKINGEYSTKSGLEDILDEAYTSPQNKKAIRQVIKVVEDIEKAMQCEPASISIEFTRRKEKSRLTNTRYKKISETYEKITDELMSEYELGRLQSELENNANDMRDRYYLYFMQLGRDMYTGEKINIDELHQKYDIDHILPQSFIKDDSLNNRVLTRKDINNKEKSDKTAADLYATKMGNFWRKLYEQGLITKQKYNNLLTRTDSINKYVKQGFIKRQLVETSQVVKLVANILQDKYANTKIIEIRAKLNSDLRKEYELIKNREVNDYHHAIDGYLTTFIGQYLYRTYPKLQSYFVYNNFKKLDSKYLERLGRFNFLWQLEDNKTIDVYDNTNNEFVLNVPEMKEYIQKINNYKYMLVSKEVTTERGAFYKETKYKAGGTSLIPIKQNRPINIYGGYKEKRNSYMMLVKINKKKETIYKIVGIPRLLSDKLDRLSTAGEKQLLLEEIARTSLSKTEQDFKIILDKIYYGQLIVDGNQKYTLGSVIYKHNAMQLHLSKKALEALAVGKTRSREISNEELIAVYEEILLAVNKYFELYDISKFRQKLNNGLEIFKELPIYNIYENNKIKKVGKFEVLNRILIGLHANAMRTDLSVLGFKDLGKLQVNGGIKLSPDAKLIYQSPTGIFSRVVRVKDLG

SEQ ID NO: 1026 - protein, 1056 aa, Haemophilus
MENKNLHYILGLDLGIASVGWAVVEIDEKENPLRLIDVGVRTFERAEVPKTGESLALSRRLARSARRLTQRRVARLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTSLLMWQKPALSGEAILKMLGKCTFEDEYKAAKNTYSAERFVWITKLNNLRIQENGLERALNDNERLMLINQPYEKAKLNYAQVRSRLNLSDEAIFKGVRYSGEDKKAIETKTTLMEMKTYHQIRKVLEGNNLKAEWAELKANPTLLDEIGTAFSLYKTDEDISGYLAGKLSQPVLDVLLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKTKDILKMRLYKQQNAKCLYSGKPIELHRLLEKGYVEVDHALPFSRTWDNSFSNKVLVLANENQNKGNSTPFEWLDGKHNSERWRAFKALIETSAFPYAKKQRILSQKLDEKGFIERNLNDTRYVARFLCNFIADNMHLTGEGKRKVFASNGQITALLRSRWGLAKSREDNDRHHALDAVVVACSTVAMQQKITRFVRFEEGNVFTGERRDRETGEIIPLHFPAPWQFFKQEVEIRIFSDNPKLELENRLSDRPQANHEFVQPLFVSRMPTRKMTGQGHMETVKSAKRLNEGISVIKIPLTKLKLKDLELMVNREREKDLYKSLKARLEAFNDDPAKAFTESFVKNGWAIVKSIRVEKVQKSGVLVHAGNGVADNASGSIVRVDVFIKDRKYFLVPIYTWQVAKGILPNRAVIADTDENEWEMMDENSTFQFSLHPNDLIRVKTKKDEFWGYFNGLNRHTGGINIRTHDLEKSKGKQGIFEGIGVKIALSFEKYQVDELGKNIRLCKPSKRQPVR

SEQ ID NO: 1027 - protein, 1132 aa, Rothia dentocariosa
MSADSLNYRIGVDVGDRSVGLAAIEFDDDGFPIKKLAMVTFRHDGGMDPATGKTPKSRKETAGVARRTMRMRRRKKKRLKELDKKLRDLGYFVPRDEEPQTYEAWSSRARLAESRFEDPQECGEHLVRAVRHMARHRGWRNPWWSFSQLEEASQKSSETFGRILERAQHEWGERVSDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARIAENSGLLEVFESWSDEEKQTLQDLKFDSGRAAYSIDTLNKLNAYMHEHRVGLHEARQNIFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRPQNGSVHKDTVEAVLERTVGDSWTDKQVSRIVDPNTYIAFLSLLGKKKELEADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLTVLPENRWKVVGIGDNRRFKIRPLLLSNEIIPDTLNGRSIKSEERDLIVSVLDKGVRVVASTLLTLPSTKIIRRNNLGIPRWRGNGHLPTSLDIQRAATQALEGRD

SEQ ID NO: 1028 - protein, 1357 aa, Granulicatella
MIKLFCKLLNLGGCFMNKPYSIGLDIGTNSVGWAVITDDYKVPSKKMKVEGNTDKKYIKKNLLGALLFEGGETAKETRMKRGQRRRYTRRRNRLLYLQEIFKSEIDKVDPNFFMRLEESFLWPDDKQGSKHPIFGTLKEELEYHETFPTIYHLRKELADSDTKADIRLVYLALAHIIKYRGHFLFEKVDPKNANLKGNFSKFVDIYNEVFDDDKDSSVEVESILVAKSTKSKKIEDIIKLYPGLKKGDFFAKFISLAVGTSVSFQKEFELENECKLQIPRESFEEDLEGLQGQIPDEYFEVLYSAKALYDSILLSSMLSDISGTEAPLSSSMVRRFTEHKEDLERLKRFFKSHPTYDYNSFFNDNTKPYYAGYIDGKTSQVEFYKAVKKFFEKDNDAHWIIDKIDQEDFLRKQRTFDNGAIPHQIHLAELKAIIEKQKKYYPFLEKEAERIEIILTFRIPYYVGPLSNGHSKFGWIVRRGNEAIKPWNLEEQIDKGATAEQFITRMTNRCTYLPSENVLPKHSLLYEKFMIFNELTKIRYVLENNKHFAVDNEMKIKIFEMLFKKTRKVTEKQLLAFFDKEYPDFHITKVMGLDRKKPQFNSSYATYHDLKKIVSQEYLDNPENAEEIEDIIQTLTLFEDREIIREKLSEYKDHFTKEQLKKLERRHYTGWGQLSKKLICGIRDKQTHKTIMEFLEDDGYTNRNLMQLVTADELSFAKEIKDASSIDTTQSLRELVQEIPGSPAIKKGIHQSLKIVEEIRRVMGYDPENIVIEMAREAQATAEGERRSRERMRSLEKALAEFEGKVNVSLPKENKLLTNKRLYLYYLQNGKDIYTGADLDINLLSTYDIDHIIPQSFIKDDSLDNIALTTREDNRGKLDNVPSSEVVRKMKGYWQQLLKAGLMSDRKYNNLTKAERGGLTEDDKKVFIRRQLVETRQITKQVARILDERFNHEKNESGEPIRKVRVITLKSKLVSDFRKKFELYKVREINDFHHAHDAYLNAIVGTLLLKKYPKLESEFVYGAFKKLTTRQTYEKATRRFLFYSNILNFLNGPLEDRVTEDGELIWDNDKDLPIVRNVLNMPQVNIVKKIERVESGPLYKETIHPREEKDDSKLISIKRNLSTKKYGGYKEPLEAYSLLVAFEEIAKGNKKISRKVVKIPIKDVVLVEKDVIGYLNGKGINNTVGIFKIYKNSLFEFENGRRRLLSSATELQKGNTLYLSREFIPLLYNCSKYVDESEDDYDKYISEHKMLFEPLFERIMDFVDSYIQKPKVSDRLRKVFNTRFSESNNLEIAKSFVNLLTITNLGASSTFVFFGEEITRNNYRYNSSKEHADGILVLQALTGLYETRIDLSKFGEQ

SEQ ID NO: 1029 - protein, 1458 aa, Capnocytophaga ochracea
MKHILGLDLGSNSIGWALVQQDFENKQGKIIATGSRIIPMDQGILGDFERGNTVSQTAERTTYRSTRRLRERHLLRRERLHRVLHILGFLPPHYDAQIDFTKRYGKFIDNAEPKIAYNNGNFIFMNSFNEMIEDFKKHQPQLFYKKSNGEESKIPYDWTIYYLRKKALSQKITQQELAWLILHFNQKRGYYQLRGEEETENPNKEVAFHTLKVVEVEAEAPNKKGEIWYTVRLENGWIYRRTSKIPLDDWKGKTRDFIVTTDLNDDGTIKVDKEGKEKRSFRAPDENDWNLLKKKTEHDIDFSGKPVGTYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCAKSNPYYQEFRVLQWLQNLRIYEIETDREVTVEFIETAQDNEALFNFLMSQKEIDNESLLKYFLLAKNPQIKDKTAKIELKKWITTYRWNYVYDVADNSSKKYPMNETGYDLQRYLQKVEGLPANFLTFDITYRLWHLLYSVKDKVEFEKALKKFAQEYQLDEASFVDSFKNFKPYPNEYGSFSEKAIKKLLPLMRFGNHWNFNRIDVSTQKRIDDLINGVANDEIRTIIREKAEKYQLNSETCFQGLPLWLAQYVVYNRHAEATDIEKWTSVNDLEAYLEDFKQHSLRNPIVEQVITETLRVVRDIWQRYGGGQANFFDEIHIELGRELKKTAEERKQLSNRNQENENTNLRIKKLLAELKEDASIQNVRPYSPVQQELLKIYEEGVFSATDEVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITGNKEVTIFTEEQYKEFVKKHYANNSAKQQKLLLNEIPEKMVARQLNDTRYISKYISEILSKIVRSDEKDEGVNSKNVIPCTGKITTALKQDWGLNDVWNELILPRFERMNQLTQTQLFTSYNDRLQKNLPTVPIEYSQGFQKKRIDHRHHAMDALVIACATREHINYMNNQHALDKNKDKKEKQQSRIDLRAILCEKKNNNWQFKKPWATFTQEAKESLEHIVVSFKQNLRVINKATNYYEKWEEKNGVLVKKKVKQEGTNWAIRKPLHKETISGKIVLDRKIGKDKILTATRKAVDITFTEKIISSITDTGIQKILLNYLKYKGSPEVAFSAEGLEELNKNIAQYNNGKEHQPIYKVRIFEEGSKFPLGETGAKATKYVEAAKGTNLFFGVYQGKGKRTYATIPLNEVIERQKQGLPSVPERNEKGEPLLFTLSPNDLVYVPMEGEIAETIDFNNLSKEQKERIYKTVSFTGNECHFVKSTIASLIKSYDAKSKIGELGSLNKLEVTISGDNSRIKEVCIKLKVDRLGNITKA

SEQ ID NO: 1030 - protein, 1134 aa, Alloscardovia omnicolens
MALKRIYRIGIDVGLYSTGLSAVEVDSNGTPIRILNMQSVIHDGGVDPNSNKTADTRKMISGVARRTRRMRRRRKSRLANLDKYLESLGFPITNYGDDTFEPWMLRARLADGYIPDEEQRKYMLSVAFRHIARHRGWRNPYKSVKSLYSVSLDDLSERYDDLCDACQVNPEDGLTPAQIIGDYVASKDGQVAPRIRHSGSKAEAFAPLPQKLMQEDNAYEVRYICEQQGIDETTRRKLIDKIFYAVSPRGSASERVALDDLTHEKRATKASLAFQKFRIVAALSFLRIAIDGTERPLTIEEKNIAFDILTSMESKSRPTWTDVADALGVNRRDIKGIGGIQDDGDRISNRAPVMDSYFALAESAGALGKLVKQVIMPWWRDASDNDRERLLELLGNTIDIDSIRDDISYSNAFELIDSFDDDQLGAIDNIKLPAGRAAYSIRACQELTDRMLSTSDNLHDARKAVYGVTDNWKPAQESIGAPIGNPSADRVLKIVNRYLMNCTARWGTPVGVNIEHAREGFSSAKVARAYQKDAEAYATNRSAIFDKIKDLYPDFNRFSDSAMKRWEAIQRQNGECLYCGATLKFTTCELDHIVPRKGVGATNTKTNLAAVCTDCNRAKSKKLFSLWCHDDYAVSRGITVANAVARVEMFNFPAGTLNAANAKRFKQAVISRLTQVTEDEAPDNRSMESVSWMADELHKRIDWYYNSQRYIATEDVPERSVKVFVYSGLSTSLARRFSGIEKRIHFAGPEGKTRLDRRHHAVDAAVIALMQHNVAEVLVDKNELRKAQLYSQKDDGTDWREYSGKDDDQRFLYGRWLGNMQALLDLLNEELDDDRVQILRNLRLELGNSRAHEDTIHKLSRVRLGDKLDASLIQRASTPALYTALTRCDDFDEKTGLPENRERHIVVNGVHYGPEDETLFFEKNAAQIMVHNGSAEIGDGFHHARIYVCDKVNKAGKKTGEFYGMIRVFAADLAKSRSEDLLNVTLSDSSLSMRYGDPRTVKAIREGRARFVGHLFVGDELRLDLSQTGYTGQVKEFADFLQPWCSTKLYATWTVEGYFSPSQLRLRPSYLSAEGLEKLDMPISEDVQKIFTRGWLPSVNAVSAFFPSVIRRNGLGEIRWKSNAGLPVSYRWHE

SEQ ID NO: 1031 - protein, 1129 aa, Streptococcus pseudopneumoniae
MNGLVLGLDIGIASVGAGILKKDSGEIIHSNARLFPAATADNNVVRRGSRQARRLTRRKRHRAVRLHDLFEDYGLLTDFSKVSINLNPYKLRVEGMNIQLTTEELFIALKNIIKRRGISYLDDASEDGGTVSSDYGKAVEENRKLLSEQTPGQIQLERFEKYGQVRGDFTVEENGEKRRLINVFSTSAYRKEAERILRKQQEFNNKITDDFIEDYLTILTGKRKYYHGPGNKKSRTDYGRYTTKKDSEGKYITLDNIFSVLIGKCTFYPEEYRASKASYTAQEFNLLNDLNNLTVPTETKKLSEEQKKTIVEYAKTARTLGASTLLKYIAKLIDASADQIHGYRVDVNKKPEMHTFDVYRKMQSLETFNVNEMPREVLDELAHILTLNTEREGIEEAINTKLKGTFNQDQVLELVQFRKNNSNLFSKGWHNFSLKLMMELIPELYATSEEQMTILTRLGKQKSKEISKRTKYIDEKEITEEIYNPVVAKSVRQAIKIINEATKQYGIFDHIVIEMARETNEEDAKKDYIKRQKANLDEKNAAMEKAAFQYNGKKELPDSIFHGHKELATKIRLWHQQGEKCLYTGKNIPISDLIQNQYKYEIDHILPLSLSFDDSLSNKVLVLATANQEKGQRTPFQALDRMDDAWSYREFKSYVKDSKLLGNKKKDYLLTEEDISKIEVKQKFIERNLVDTRYSSRVVLNALQDFYKNHHFDTTISVVRGQFTSQLRRKWGLEKSRETYHHHAVDALIIAASSQLRLWKKQNNPLIFYKEGQFVDSETGEILSLNDDEYKELVFKAPYDHFVDTLRSKTFEDSILFSYQVDSKYNRKISDATIYATRKAKLDKDKSKETYVLSKIKDIYSQAGYDAFIKIYNKDKSKFLMYHKDSQTFEKVIEEILRTYPSKEFNDKNKEVPCNPFEKYRQENGPIRKYSKKGNGPEIKSLKYYDKNIPESFINITPSNSKNKVILRQLNPWRTDVYFNHQTEKYELLGLKYADLQFEKKTGTYSITIDKYNEIKEKEGVGEQSEFKFTLYKNDLLLIKDTKNNEKQIFRFLSRTMPNVKHYVELKPYNKAKFDGNQPLITIFGNVAKGGQCLKGLNKPNISIYKIKTDVLGNKYFIKKEGDKPKLKF

SEQ ID NO: 1032 - protein, 1366 aa, Streptococcus parasanguinis
MKKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGSNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLKRYISRTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 1033 - protein, 1357 aa, Lactobacillus
MTKLNQPYGIGLDIGSSSIGFAVVDANSHLLRLKGETAIGARLFREGESAAGRRASRTTRRRLSHNRWRLRFLQDFFEPHISSIDPDFFLRQKYSEISPKDKERFKYEKRLFNDRTDAQFYKQYPTMYHLRLHLMNDASKADPREIFFAIHHILKSRGHFLTPGDAKNFNTDDVDLKRIFPALTEAYAQAYPDLTLSFEASKAEKFKSILLDEDATSNDTQKALVKLLLVDDGDKELLKQQKKVLTEFAKAVAGLKAKFDVALGIEVANAENWHFGMAQLEDKWSDIEPSLTDQGMEIFEQIQDLYRARLLNGIVPAGKTLSQAKVDDYDQHCKDLKLFKEYLKQLNDHDLAKRIRLLYDRYIDGDDAKPFLRDDFVKALKKEVTAHPTELAESLLERMEQDNFMLKQRTKANGSIPVQMQQRELDQIIANQAEYYSWLAAENPVKEHRDSKPYQLDELLNFRIPYYVGPMITKKQQEKSGQNVFAWMVRRDPSGNITPYNFDEKVDREASANAFIQRMKTTDTYLIGEDVLPKQSLLYQKYEVLNELNNVRVNGESLSTDKKKRLIRELFERHSSVTLKQFVENLVAHGDVAKRPDVRGLADEKRFLSSLSTYHQLKAILGDAIDDRDKLTDIEAIITWSTVFEDAAIFKTKLNEVSWLDSKTRTSLSNIRYRGWGQFSHKLLDGLKLGNGHTIIQELVLSSRNLMQILTDTTLKEEIAALNQERLKPDSINEAIDDAYTSPSNKKAIRQVLKVIEDIKHAANDQAPSWLYIETADGGGRPGKRTLSRQKQIQAIYENTAKELIDSAVRGELKDKIADKTNFSDRLVLYFMQGGHDIYTGTALNIDQLSSYDIDHILPQSLIKDDSLDNRVLVHAKINREKNAEFASTLFAAKMASTWHRWRDAGLISGRKLKNLLMRPDEVDKYAKGFVARQLVETRQIIKLTEQIVAAQYPDTKIIAVKAGLSHQLRQELDFPKNRDVNHYHHAFDAFLAARIGTYLLKRYPNLAPFFTYGEFTKTNLKKLQSFNFIGALTHADKKITSKDTGEVLWDNQRDIEELDQIYNFKRMLITHEVYFETAGLFKQTVYAAKDSKERGGSRQLIPKKKGYSTEVYGGYSGENTAYLAVVRLVKKSGVTYKVIKIASSQAAFLGKAREKSLLEEKKLLEKMLISKFSKSGKSNSTQLEIVLPRVPREQLFHNKKYGLFLVNSDTMFHNFQELWLSRSDQKLLQKILRDSKVDEARGEEIDYLFSSIVQQVTQYFALYNIAGFRKKLQQSLEKFKSLKVSDVDATSGKISTIKELLKGTQANGVTGNLKNLNIATPFGFTQDKSGILTEDTSIIYQSPTGLFKRVIRLADL

SEQ ID NO: 1034 - protein, 1106 aa, Corynebacterium falsenii
MPTHSLKRYRVGFDVGSRSLGIAAIEIDENGMPANILNAMSFLHDAGLDPDSNKTALTRKNVSGVARRTRRMYRARKKRLEALDRFLSSHDYPLEDLANTEDMECWQARASLTSAKLTDETEFKRAFSLALRHIARHRGWRNPYSTTRSMHSQQLEPSPSLLKIREEFALLCSTPLKADATLAEMVCQLPDARVKLRGEGGLFSERLHQKDLALELHKVARGQGLEPAFICKAIDKVFDAKSPKGSASDRVGKDDLDRSQPRAWRAAREFQEYRIIALLANVRVREKEDGSKGILRPLTLAERQKVFEFLNTFTEKIPPTWGEVASLLNIDRGDLKGTATSTDDGERVSSAPPVNDTERTMANSKIKEIRNYWKDANQASKDALIREFSNVELPEDDSPEAIAASTLLRNLPEGSLENLESIRLSDGRSAYSLKTLRKLTDYMLNNEADLTDARMAIFNVDKDWKPAAAPIGEPTGNPAVDRVLKQVNRWLNMAESRWGLPESINIETLRDGFKSERLAREIERDQNQRAKKNLTVVDAMRTKLNIEGRPRRSEALRFQSIQRQNGQCAYCGSPIDFKTAELDHIVPRAGVGSTNARYNLLATCGRCNRAKGKLPFAVWAKKTEILNVSLEGALQRVQQWTTDPGLNASNMKRFQQEVIFRLKRVSEDEEIDARSKEAVSWMAVELQHRLLGYYGRSKERGSSPVKIHVFRGEVTASARRAAGIEKSFRMIGGKAGKNRLDRRHHAIDAAVIAMMQGTVAQVLTERNSLRSQQHYSGKPDAEFGAWSEYTGRRVQDQVVYRSWVQKMKALVPLLQQAIDSDHIPVVENIRLKLGNGLAHEETVHPLTRVKLGDPIAPDAVDRASTPALWTALTREPDFDWKEGLQENPNRKIQVNGTQYTATDEIELFGVKAGAIKVRNGYSELGSAFHHARLYKIRGSKKVSYAMMRVYTVDLLRYRHQDLFTCELDPNTMSARQAEPKLRAAFRAGTAEYVTWFVVGDELKLNTPNIATGQVSTFLEEFGEVTHWRIRGLYSNSKLRLKPSQLASEGISETTSADSRKVIDSPGWLPAVNKVFGEGNPILIRRDAHGRPRLESESGLPISIVIG

SEQ ID NO: 1035 - protein, 1053 aa, Staphylococcus hominis
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEQLRSVKYAYNADLYNALNDLNNLVITRDENEKLEYYEKFQIIENVFKQKKKPTLKQIAKEILVNEEDIKGYRVTSTGKPEFTNLKVYHDIKDITAKKEIIENAELLDQIAKILTIYQSSEDIQEELTNLNSELTQEEIEQISKLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRELMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKYPQIIKKR

SEQ ID NO: 1036 - protein, 1130 aa, Rothia mucilaginosa
MKNYGIGIDVGYRSVGCAAIEFDDDGFPIKTLSLVSFRHDGGLDMKGDKPKIRKATRGVARRRMSMNRRRKRRLRNLDKVLSNLGYTVPEDSGSETYEAWTSRALLASIKLASADELNEHLVRAVRHMARHRGWANPWWSLDQLEKASQEPSETFKIILARARELFGEKVPVNPTLGMLGALAANNEVLLRPRRSYKAEEANNPKKAEKYLADYGTQPLMAAKVCQEDQLAELRRICEVQGIEAQYENLREAVFTHVRPYVPKDRVGKDPLNPSEIRASRASLEFQEFRILDSVANLRVRTDSRTKRELSESEYDAAVDFLMSYTGKEQLSWADVAEEIGVPGNRLIAPVLEDVQQKTAPFDRSSAAFEKAMKAKTEARKWWESNDDDQLRSLFIMFLADATDDTAEAAVEAGLHELFASWPEEEREVLSNISFESGRAAYSAKTLSKLSEYMHEHRVGVHEARKAVFGVDDTWRPPLAKLEEPIGHPTVDRVLTILRRFVLDCERQWGRPHAITVEHARTGLVSPAVRRKILKEQEDNRKNNERIRGELRKSGVENPSRTEVRRHLVVHDQESQCLYCGAVIRTDTSELDHIVPRAGGGSSRRENLAAVCRYCNAMKSNTPFYRWASPEKLKETIDRVHQLKAFKDPKKAKMLKNQIRRLKQSEADDPIDERSLASTSYAAVAVRERLEQHFNEGLAPDDKSRVALDVYTGAVTRESRRAGGIDERILLRGEHDKNRFDVRHHAIDAAVMTLLNRSVALTLEQRHQLKREFNETKRENGWRDFIGLYPASKEKFLKWKKAATVLGDLLAEAIEDDSIAVVSPLRLRPQNGAVHDETIHAVKKQTLGSAWSAEAVKRIVDPEIYLEMKDALGKLKELPEDSARTLELPDGRFVEADDEVLFFPKKAASILTPRGAAEIGDSIHHARLYGWMTKEGELKFGMLRVYGAEFPWLMRESGSRDILHMPIHRGSQSFRGMQVGVREAVESGEAVEFGWITQDDELEFDPEDYIAHGGDDELNRLLRVMPERRWRVDGFYNAGTLRIRPALLSAEQLPSELQKKVASKTLSDVELILLRAVQRGLFVATSGFLPLESLKVIRRNNLGFPRWRGNGSLPTSFEVRSSALRALGVEG

SEQ ID NO: 1037 - protein, 1049 aa, Haemophilus parainfluenzae
MENKNLHYILGLDLGIASVGWAVVEIDKKENPLRLIDVGVRTFERAEVPKTGESLALSRRLARSARRLTQRRVTRLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTALLMWQKPTLSGEDILKMLGKCTFEDEYKAAKNTYTAERFVWITKLNNLRIQENGLERALSDNERLMLIEQPYEKAKLTYAQVRSILNLSDDAIFKGLRYSGEDKKAIETKTTLMEMKAYHQIRKVLEGNNLKAEWAELKANPTLLDEIGTAFSLYKTDEDISAYLAGKLSQPVLNALLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETTAFPYAKKQRILSQKLDEKGFIERNLNDTRYVARFLCNFIADNMLLTGEGKRKVFASNGQITALLRSRWGLAKSREDNDRHHALDAVVVACSTVAMQQKITRFVRFEEGDVFTGERIDRETGEIIPLHFPTPWQFFKQEVEIRIFSDNPKLDLENSLPDRPQANHEFVQPLFVSRMPIRKMTGKAHEETLRSPKKLSEGKSIKKERLSNLKLTDLERMVNKEKEPELYQSLKEHFSKYGDYSKEKFFKKGGTEVKSIRLYKTQNKYVELNNGKTIADNGDIVRVDVFKKEKKYHAVNIYAWQVAKGILSKETSTGLFLDDNYIFQFSLFKNDLIKIPDPNNKSEYLFAYFIRPDDEPRWILKLQDNAIIPDGFSKKEKNSFRFSFKNQSFIEKYHIDELGKNINLCKRSKRQAVR

SEQ ID NO: 1038 - protein, 1122 aa, Streptococcus oralis
MNGLVLGLDIGIASVGVGILEKNSGKIIHANSRIFPAATADNNVERRKNRQARRLHRRKKHRGVRLQDIFEDYGLLTDFSKVSINLNPYRLRVDGLDQQLTNEELFIALKNIVKRRGISYLDDASEDGGTVSSDYGKAVEENRKLLAEKTPGQIQLERFEKYGQVRGDFTVVENGEKRRLINVFSTSAYRKEAERILRKQQEFNSKITDEFIEDCLKILTGKRKYYHGPGNEKSRTDYGRFRTDGTTLDNIFGILIGKCTFYPNEYRASKASHTAQEFNLLNDLNNLTVPTETKKLSEEQKKVIVEYAKEAKTLGASTLLKYIAKMIDASVDQISGYRVDVNNKPEMHTFEVYRKMQSLETISVGELSRNVLDELAHILTLNTEREGIEEAINTKLKDSFSQDQVLELVQFRKNNSSLFSRGWHNFSLKLMMELIPELYETSEEQMTILTRLGKQKSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELATKIRLWHQQGEKCLYTGKNIPISDLIHNQYKYEIDHILPLSLSFDDSLSNKVLVLATANQEKGQRTPFQALDSMDDGWSYREFKSYVKESKLLGNKKKEYLLTEEDISKIEVKQKFIERNLVDTRYSSRVVLNALQDFYKAHKFDTTISVVRGQFTSQLRRKWGLEKSRETYHHHAVDALIIAASSQLRLWKKQNNPLIAYKEGQFVDSETGEILSLSDDEYKELVFKAPYDHFVDTLRSKTFEDSILFSYQVDSKYNRKISDATIYATRKAKLDKDKSEETYVLGKIKDIYSQAGYDAFIKIYNKDKSKFLMYHKDPQTFEKVIEEILRTYPSKELNDKNKEIPCNPFEKYRQENGPIRKYSKKGNGPEIKCLKYYDNKLGNYIDITPDGSDNQVVLQSIAPWRTDVYYNHKTGKYEFLGLKYSDLYFEKGTGKYKISKEKYDNIKKIEGVVETSEFKFTLYKNDLILIKDVEKGQEQLFRFLSRNNKGKHQVQLKPMNKSDFEKGEKLIDIFGTVPNSTTQCVKGLNKSNISIFKVKTDVLGKKHIIKKEGDEPKLKF

SEQ ID NO: 1039 - protein, 1378 aa, Streptococcus pseudopneumoniae
MSNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLKRYISRSKDPKDIEKATEKYFFYSNLLNFFKEEVHYADGTIVKRENIEYSKDTGEIAWNKEKDFATIKKVLSYPQVNIVKKTEEQTVGQNGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 1040 - protein, 1136 aa, Rothia mucilaginosa
MSTDMKNYRIGVDVGDRSVGLAAIEFDDAGFPIQKLALVTFRHDGGLDPTENKSPKSRKETRGVARRTMRMNRRRKQRLRDLDKVLENLGYTVPEGPEPETYEAWTSRALLASIKLASADELNEHLVRAVRHMARHRGWANPWWSLDQLEKASQEPSETFEIILARARELFGEKVPANPTLGMLGALAANNEVLMRPRRNYNAKEANNPKKAGKYLADYGTQPLMAAKVRQEDQLAELRRICEVQGIEDQYEALREAVFTHVRPYVPKDRVGKDPLNPSEIRASRASLEFQEFRILDAVANLRVRTDSRAKRELSESEYDTAVDFLMSYTGKEQPSWADVAEEIGVPGNRLIAPVLEDVQQKTAPFDRSSAAFEKAMKAKTEARKWWESNDDDQLRSLFIMFLADATDDTAQAAIEAGLYELFESWPEEEREALSNIAFEAGRAGYSATTLSKLSEYMHEHRVGLHEARKAVFGVDDTWRPPLAKLEEQTGQPTVDRVLTILRRFVLDCERQWGRPQAITVEHARTGLMGPAQRQDILREQKKNREENERIRNELRESGVENPKRVDVRRHLVIQEQECQCLYCGTMITTTTSELDHIVPRAGGGSSRRENLAAVCSYCNGQKNNTPFYRWASPERFKETIDRVRQLKAFKDPKKAKMFKNQIRRLKQTEADDPIDERSLASTSYAAVAVRERLEQHFNEGLAPDDKSRVVLDVYAGSVTRESRRAGGIDERILLRGEHDKNRFDVRHHAIDAAVMTLLNRSVALTLEQRHQMKRESAETKRDNGWRDFTGLAPASQEKFLEWRKAATVLGDLLAEAIEDDSIAVVSPLRLRPQNGSVHKDTIAAVKKQTLGSAWPSDAVKRIVDPEIYLAMKDALGKLKELPEDSARSLELPDGRFVEADDEVLFFPKNAASILTPRGVAEIGESIHHARLYGWLTKKGELKVGMLRVYGAEFPWLMRESGSRNVLSMPIHPGSQSFRGMQDAVRKVVESGEAVEFAWITQNDELEFDPADYIAHGGDDDLRRFLEYMPECRWRVDGFYDVGRLRIRPALLSREQFPLDIQRSLDEKKPLTVEQQVIVKSLEKGLAISLGNLMGLETMRVIRRNNLGFPRWRGNGSLPTSFEVRSSALRALGVEG

SEQ ID NO: 1041 - protein, 1391 aa, Lactobacillus kunkeei
MKNYHIGLDIGTSSVGFAARDDDNNLIRVKGKNVIGARLFSEGKTAQERRISRTSRRRYNRRKWRLRLLDEIFHDAIVHKDAEFFNRLKQSSLSPKDERKQYFGSLLFPEVGDGDYFRDGNQTIYHLRHRLMTQDEKADIREVYLALRHIIKYRGNFLDDTPVSSFEASDLKLASFVPTLNDLFETINVNYELSIDNVNQIENILLNNKLRNSDKSKQLTDLIAEPVTNIDDKSLKKQFDKERKDISKEIAKAVVGSKMNVNKLLSFESSDGSKISFSFSDASSEDKMLELSDILDDSRMNILNVLKVIYSRVRLNQIIPSGMGLSESMIAAYDLHKQQLKDLKTLLDVVPFNEKYAVKIAYAAYIGNIDKQRFTKAEVKTIDKLRDKKSITSVLDFKSGHITNEELNNVIKEVIVDKYLNDETFEYHDIVEKINQDISNGNYLLKQRNNQNGNIPHQLHQMELDQIIEKQSKYYPFLGKLNPNSKRSHIAKYKISELVAFRVPYYVGPLITPEEQEKTSGASFAWMKRKEDGAITPWNFEKMVDKESTASRFIKRLTVKDTYLLNEDVLPDNSLLYEKFKVLNELNVVKANNKRLTVEEKQGAFDNLFKQMKTVTAKRLKNYLVSNHNHINSVKITGLSDGEKFNNSLSVYIDFKKIFGDKIDDSKLFDDFENIIEWSTVFEDRDIFEEKVRKDISWISESEINAVVSKRYSGWGRLSKKLLNGITNDEGRNIIDELWEESETFMEAVSKPEVKEKIDEINSNFIKNTDIESVLADAYTSPQNKKAIRETYKLVKDIQKAMGGQAPSSISIEFTRNPQDKGELTRSRHSEIAKKYKELSKEVSKKLNDELKSKKNSMDVDKYYLYFMQMGIDLYDGTSIDIDDLNNYQIDHIVPQSFYKDDSFDNRVLTHYSNNQKKGNNTPLNGLNIDSNTREVWNHLIGLGLITKRKYNNLTLKGMDQLSKYTKHGFIRRQLVETSQVIKLVANILSDEYSKDDTKIIEVKAKLNSQIRQVFNLYKIRELNDYHHALDAYLTTFIGGYLYNRYPNLRNMFVYGDFKKFSAKIDNLETFNFLHDITNPSDKFEDRIIDEKSGEVILDRRHAIETIKKIYQYNYMLITREVSTKNGQLSDQTVYSARRINKVNSPIPVKKDSNPELYGFRTGNVDHHMVIVKYLNKDKYDYKIIGIPLRFVQVLKNSNDNTEYKNILNKIVQSKLKGKSTDFRVILDNVMYGQLIQDGGQKFTLGSSTYKYNAKQLVINMDDIRILVDNRYFNSLSDDDASGEFIKIYNEILKVINARFDLFDINKFREKLNNGKEYFENLSIDEKNQVLLKMLSGLHCGSANVPIKELGLTTPLGKLQIPSGIVLSEDAIVIYQSPSGLFERKIRLKDI

SEQ ID NO: 1042 - protein, 1077 aa, Bacillus cytotoxicus
MKYSIGLDIGIASVGWAVINEDIERIEDLGVRIFDVAEQPKTGASLSTPRRLARSTRKRLRRRRHRVERVRKFMIQKGLLTQVQMEQLYDWKDGDLDIWLVRVNALERKLSDREFARILVHFAKNRGFQSNRKSELQEEDNGAVLSAVQENKRLMEEKGYQTISEMLLYDEKFEGTKRNKGGEYTHVVARSDLKREIQLIFEKQRAYGHAFATMENEDKFLQIWSSQRPFATKDDIAKKIGNCTFEPKEKRAPKSTYTFERFRALDKLNRLRILSGTSPARSLTQEERDLILNSLFSKKEVKYKELRKLLKLNDEQRFNEIFYDPNEKIEKNENRTFLSLESQYKIRKILQKIEGKSLNDTYRPVDLDTIAYALTVFKDDQDIRDYLQNQYVASNGKKELNLANRKYNDELIEELLHLSFTKFGHLSLKALRNILPFMEQGIPYHQACEKAGYQFNKKVNREKQKLLPPVPAKDIVNPVVIRSLSQVRKVINGIIKRYGSPSSIYIELAREMGRGYKERKDLEKQYNKNRQMNEGAKKHILELRPEFGDPRGHDILKYKLWQEQDCRCAYSFKSIPIKQLFEIGYAEVDHIIPYSRSFDDSNNNKVLVLAAENQNKQNRTPYEWFGHDETKWQEFTSLVTTMKVSKKKKSLLLKKNFDEEQAEEFRSRHLNDTRYITRYIKTFIEDNLQFRIEEGKKTYVHTVNGAYTSLMRKRWGFNKNRQENALHHALDAVIVAVSLPFKHKVRAYFKRREEYAHNQLKREGEFFPEPWPGFIHELEIRMMQDSENIKLAMESLNLKTYDESFIKELKPIFVSRMPKRAMKGQIHEETLKRVRGRTDDGYIRTVKKVKLDQIPFDKNGDFPMFGKETDMKTYEAIKSRYLESGKDKKKAFNTPLYKPAKNPENAPIIRSIKIEEKANRVVMLDEKTAADNASIVRTEVFRHKETGNYFLTPVYVADVLAKKVPDRLITTKKPYSEWRKITDEYEFLFSLYPNDLIRVKMPKEKETKTHTGEKHVWQENFMYFKGVHSGSAGVRMIDHMNSFEDEIGVRKLVVFEKYQVDPLGRMNKVHGEKRHGI

SEQ ID NO: 1043 - protein, 1038 aa, Actinobacillus capsulatus
MKLTPLNYILGLDLGIASVGWAVVEIDESGNIIRLIDLGVRTFDAAETGKGESLNLVRRSTRATRLLIYRKAQRVRELRYLLKNEGMIDDAIASYKLPNNVWELRVEGLDRKLNKEEWAAVLLHFVKHRGFKSSRKHQPKDGGKQGQLIKGINDNKILLASGVYRSPAELAIKKFYVEDGYIRNQRQYQHTFGREELAAECALLFETQRKLGNPFSSKEFESKWADIFNKQKKALTRKQMLAMVGICTFENTKYGLTEQKRAAKNTYSTERFVAIQRLQNLRIVENGEEKGLTDNEFQKILSLGYELEKGVSYARVRKELNLSEKAFFKGLQYSKYTKKTEDSLFLNFKFYHTLHNTLLSNNLENEWNEISKNDKLMDKIGTELSLCKNQDEFLESLSDELPKNVLNVLFENIHFDKFIHISLVALYKLLPLMEQGYNYAQAHTEIYGYSQIEDKKFLSAIPLADIHNPVVLRSLTQARKVINGIIRLYGSPTRIHIELSRDLGKSKVDRDAISKQNAKNRASNDELAKQIREEFQFEPKAKDILKYRLYIQQNCHCIYSNKKIDCKRLFEDNYVELDHALPLSRSWDDSFNNKVLVLKYENQNKRNLTPYEWLDGKNDSLQWRTFVARVNSFSEISKEKKQKLLSHNINEDEFKSRHLNDTRYIARYLKNHIEEHLMITGKGKNVLATNGRITSLLRKVWGLNKDRDLGDRHHALDAVVVACTQSKLIQQITEDIQHNRICRFTGEPKKKIFIPWEHFTADVNIRVFSDNPKLELENRLPDYPQYNHEFVQSLFVSRMPTRKMVGLGHEATLRSARILDTTGKSIKKEFLTDLTLKNLENMMNKEREPELYQSLVEHFKKYGDKPKEKFFKKGGTEVKSIRICKTQNKFVDLGNKTIADNGDIVRTDLFLKGKKYYFVNIYAWQVAEGILPNETTMGNLLDDSYIFQFSLFKNDILEIPHPEDKNKSVFAYFIRPDDDRRWILKFHDNAKIPEIYSKKDDTSIRLSVQGQKFIRKYQVDELGKNIRPCRPTKRQHVR

SEQ ID NO: 1044 - protein, 1072 aa, Anaeromusa acidaminophila
MNYTIGLDIGVASIGWAVIDNDNKRIVALNENLFDKAEDYKGKSKAEVRREKSSRSKTVRRKAHRLIRVRRLFVNTGLLTKDIVTNFHFHPSLLNKPNDLGKRTRKSPYQLRAEGLDRCLSNIEWAVVLFHLAKHRSFISVDTKDENAQKMKKAINENRSLLTMCAYRTVGEMYYKDDKFKEKCRNKGGEFTATINRQMLLDELTLLFEAQRSFGNQYSSVEFQQKYVTIFSSQRPTFTNSAIEKMVGYCTFEPHQKRAPKNSYTVERFNLLRDLSQLKYMIGIEEFFLTMEEKQAIIDLAYSKEKVTYSNIRTILNKKFKFPPNAIFKGHPIDKEQKNFTSLKGYHTLKKALSPLGANEWNVFSQNYRLLDQTVESIALGKNEANIIKRFKKIGLPPKYHSLLCNVSFSKFSHLSFKALNNILPLMESGMTYTAACANSKYKGHYIKNTQIQKTDPLILPLIPQTLFSNPVVFRALCKTRRIVQAIIKRYGLPYAIHLETARELSNSDEKKKEIEEQQNKNRKATEILVKELKEFGITTPKYSLIEKYRYYKEQDGICPYSGEPINLDMLLSDLYGSIYEIDHIIPYSLTQCNERSNKVLVKQSENQNKSNRLPIEYLGRDKERWDRFCTWVKGSRLSVRKKQTLLREPLTKEESECFRTRNLTDTQYAATAAAEYLKVGVTFSDKNNRKPIVLIKGAVTGFLRYNWGIKKDREKFLQHAQDAAVVAVASEKMLQQISEYYKLKETQPQLFYNKDNRPSFPMPWPFFNNELKARLSANPVEKIAAYKRIHKIPPVYYDEDISCYKPLYPSIAVRYKINGCLLDETAQSALPKYIKEGYTIKKIPLTELEPKHLIEDKDGIIPVVGADKDVAFREALLKRFTDIISIDEYYKKSLTEIKKISKQAFTEKFFKPSKPGRVPSLVKSIRIIDKGTAGHIKNNALYKNGTDSLFKVSIFKKNESYYFVPHYRLPALQKKEVLKAIVPKNSEENWIPIDETFHRCFSLYKNNLVRLITVRGEEHIGYYKGTHRRINAINLLSKETSFSITAPQIKYIELLFVSVLGDITRSKGDFS

SEQ ID NO: 1045 - protein, 1069 aa, Salsuginibacillus kocurii
MSDTIDYRIGLDIGTNSVGWSIVELEFNGEQYETVNLIDAGVRMFDKAEVPKTGASLAFPRRLARSTRRRLKRRANRKKAIRNLLINQDVVNEKELEKLFQSPTLIDVWSLRVEALDRLLGREEWARLLIHLAQKRGYKSNRKAEESTKEGKVVLSSINENTERLKRYRTVGEMWVEDPHFEGRFHNQENEYKFNVTRHQLEEEIRFLFKQQRELNSPYASNELEEHYLNIWGHQLPFTSGNSILNKVGQCSLLENEKRFPKATYTFQYFMVLDKLNRIRLKPSVRKLTQEERSHVINSLFNRSNIKKTPPKVKYKDIRKIIEIAEEETFHDVVYDTEKSITKNEDIPFVNLDSYYKIKKVCDEHKEEYGPADYDAVGYALTVYKTDHDIRLYLRNPENLAKRVFEEKFIQTLLLQSYSTFGHLSQKGIQAILPFMEEGMTYIEAAQQAGFNTTGFKKEGKSKFLKVIPDDIRNPVVMRSLTQSRKVVNAIIKEMEEQPQSIHVELARELSKDNDERKKISNQYEKNRKRNEGAVKILSENGILNPTGHDIVKYKLWSEQRGHCMYSLKPIPAEEFFAELKAERNRAPMLDVDHIIPYSKSFDDSYSNKVLVYSDQNRIKGDRLPVEYFDGDIDRWNEFIGFVNSCDFSKRKRTNLTKKRLNEEEEQLIKERHLNDTRYASRYFKNYLEEHLKFKVSEKKKDKKRVETVAGKITSHLRKRWGLVKHRQDTHLHHALDAVVVACTDTKIIQDVIRYYRLKEESRAESNIYFPLPWKTFRNDILHRLSLVAVPEQVKEALEGDQEQTEYMLVSRMPRRSITGAVHKETISTFGGYDEKGKVLMVQKVPLNEIKFDENGDFKMFNKESDPATYEVIKQRLLENNGDSNIAFEKPLYKPSKKGNGNEIKRVKVIKEQKTMMRQVNGGIAENGDLVRIDFFQKDKKYVMVPIYTWDTIEPVLPDKYVVGGKGYQQWPKITEDYHFSASIYPYELIRVVTKKGVDRFYYFSSLNIGKNVIKVIECNIPHQEYIEIGVNSITLLEKYEMNVLGKIKGVVQDSRNTFSNYKIKKHTQ

SEQ ID NO: 1046 - protein, 1096 aa, Corynebacterium caspium
MTRYVVGIDVGSYSVGMAAIELDEQGFPVQLLNAVSQLHDAGVDPDSQKSADSRLSKSGLARRTRRVIRRRRERLQKLDKFIAAQGWPIMSLEDYENPHHPWIVRAELATTKISDPAELQEKLSVALRHIARHRGWRNPYSSTASLLNVEKNSEPFEQILANIAEKTGKLIPENTTVGQAILIGIDRGYRIRKGAADGDAQTEGLLSAHLQQSDHARELAAIFAKQELSHDLYKDVIEVVFAAKSPKGSAARKVGKDSLPGQTHLPRALKASEAFQLYRIVSVIANLRLIVEGTARPLTKDERVAVYEYLSTAKSRNKASWDEVASILKVDRGQIRGTAAMTDDGERVSARPPIHDTNAIMGSLKLKALANFWKNSDSEIRAAVLRALSNSEARDDSSEADAQLDEFLADLSEKEQEELDKISLPVGRAAYSEDSLTRLTAVMLNEGVDLSTARQLEFGIPKNWQPPAPEIGEPVGNPAVDRVLKIVARWLAGVTKKWGEPERVTIEHVRDAFSSKKKTSEISRKINERAKRNESLRENIRKARGFDGYVSRADLWRYQSITRQNGQCAYCGTHITMSNSQMDHIVPRAGQGSTNTRDNLLAVCSACNSDKTNLPFAIWAAKTSRPNVSLKEAQERIKHWNKDPAMKALDFAYFKRSVLKRLKRKTIDEEIDTRSIESVAWMANELRSRIAHKYSLLEGQQESPKVQVFAGAITSEARKAAGIEKELKYIGGVGKTRLDRRHHAVDAAVVALITPFVAQTFEERMNLRFSEELSNSKSTWKTYTGADYAHRQQWEIWQLKMQKLLQLLQDALDNDQIPVMSNIRLRLGNSRVHEDKVSALEYHPLGEELSSSLIDRASSEALWCALTRDPDYVFKKGLPANPNRTIQVNGTHYGPSEEIGFFAVKAASIPLRGGYAELGKSIHHIRIYRINTGKMPTYAILRVYAVDLQRHRNNDLFNAEIRPQTISMRKAPDTLRKAIAAEAAEYIGWVVTDDELFIDSVLNTELNEAYGDVKRWRIVGSTDDNRFVLRPSQLSSEGLDSKASNNIQKIIKIGLRISVNELLKKHGITVVRRNALGVERIKSSANLPVSWSIKKI

SEQ ID NO: 1047 - protein, 1055 aa, Rodentibacter pneumotropicus
MQNNPLNYILGLDLGIASIGWAVVEIDEESSPIRLIDVGVRTFERAEVAKTGESLALSRRLARSSRRLIKRRAERLKKAKRLLKAEKILHSIDEKLPINVWQLRVKGLKEKLERQEWAAVLLHLSKHRGYLSQRKNEGKSDNKELGALLSGIASNHQMLQSSEYRTPAEIAVKKFQVEEGHIRNQRGSYTHTFSRLDLLAEMELLFQRQAELGNSYTSTTLLENLTALLMWQKPALAGDAILKMLGKCTFEPSEYKAAKNSYSAERFVWLTKLNNLRILENGTERALNDNERFALLEQPYEKSKLTYAQVRAMLALSDNAIFKGVRYLGEDKKTVESKTTLIEMKFYHQIRKTLGSAELKKEWNELKGNSDLLDEIGTAFSLYKTDDDICRYLEGKLPERVLNALLENLNFDKFIQLSLKALHQILPLMLQGQRYDEAVSAIYGDHYGKKSTETTRLLPTIPADEIRNPVVLRTLTQARKVINAVVRLYGSPARIHIETAREVGKSYQDRKKLEKQQEDNRKQRESAVKKFKEMFPHFVGEPKGKDILKMRLYELQQAKCLYSGKSLELHRLLEKGYVEVDHALPFSRTWDDSFNNKVLVLANENQNKGNLTPYEWLDGKNNSERWQHFVVRVQTSGFSYAKKQRILNHKLDEKGFIERNLNDTRYVARFLCNFIADNMLLVGKGKRNVFASNGQITALLRHRWGLQKVREQNDRHHALDAVVVACSTVAMQQKITRFVRYNEGNVFSGERIDRETGEIIPLHFPSPWAFFKENVEIRIFSENPKLELENRLPDYPQYNHEWVQPLFVSRMPTRKMTGQGHMETVKSAKRLNEGLSVLKVPLTQLKLSDLERMVNRDREIALYESLKARLEQFGNDPAKAFAEPFYKKGGALVKAVRLEQTQKSGVLVRDGNGVADNASMVRVDVFTKGGKYFLVPIYTWQVAKGILPNRAATQGKDENDWDIMDEMATFQFSLCQNDLIKLVTKKKTIFGYFNGLNRATSNINIKEHDLDKSKGKLGIYLEVGVKLAISLEKYQVDELGKNIRPCRPTKRQHVR

SEQ ID NO: 1048 - protein, 1127 aa, Streptococcus marimammalium
MNGKILGLDIGVASVGVGIIDSKTGKVLHASSRIFPSANADNNKDRRSARQARRLLRRKQHRVKRLKDLFDKYNLIQNDSISHSNVNPYEARVKGLSEKLTIDELYYALLNMLKHRGISYLDDAEDDGANSSSEYKKSIEENRKLLKSKTPGEIQLERLNNYGQLRGNFIVYNENNEKEHFINVFSTSDYKKEAQQILETQQKWHDNITNQFIEDFIKILTGKRKYYIGPGNESSRTDYGIYRTNGETLVNIFKILIGTCAYTGKVRAAKASYTAQEYNLLNDLNNLTYPTETGKLSQKQKEEIVIFARDNGATVKQLLKFICQLLSCDLNDIKGFRKDAKDNPEISTFEAHKKMKKGLETVDFTELTREEIDTLAHILTINTDKEAIEHAINMAINNNELPSWDNSQITELVQLRKTNSTLFGKGWHSFSIELMKEIIPELYATDKEQMSILSDNKYVSMKSKLMNRSQKTKYIDEEIVTDEIYNPVVAKSVRQTVKIINLAIKKYGEFDKIVIEMPRDKNEEEERKNIKKYQNDNNKEKDSALQEAASLYNGKDRLPHHVFNNYKDLNLRIRLWYQQEGRCLYTGQKINIQDLIDNRQNYEIDHILPLSLSFDDSISNKVLVTALSNQEKGQRTPFQAIREMKNAWTYPEFKKYVLNLKRIGKTKLNYLLTEEDINKIEVKKKFIARNLVDTRYASRVILNTLQDEFKRLKKETKIAVVRGKFTAHLRYQWRVEEKNRDTYHHHAIDALIIAASANLKLWKKMKDRLFDESEKQFVDMETGEIISIDNKEYKELVFQPPFQKFTDTLNSKELWESILFSYQVDSKVNRKVSDATIYGTRKAKIGKDKKDEDYVLGKIKDIYSLDGYDKFIKQYNKDKSKFLMYQKDPKTFENVLEVILRDYPDSKIDENGKKIKCNPFEEYRKENGLMRKWSKKENGPEIKQLKYYDTKLGNHIDITPDNSRNKVVLQSLNPWRTDVYFNPETMTYQLMGIRYSDLSYIKSDYGISIEKYNQIKKQEGIAENAEFKFTLYKNDLLLVKDTKTGEEMLVRFLSRTLPNKKNYVELKPYEKNKFDGNDKLISVLGVVSGSGRFLKSLAKPNLSLYKVKTNVLGNLFYIKKEELTLKF

SEQ ID NO: 1049 - protein, 1129 aa, Streptococcus orisratti
MTNGKILGLDIGIASVGVGVIEADTGKVVHASSRLFPSANADNNAERRGFRGGRRLIRRKKHRMKRVKDLFEEYKLETRFNNLNLNPYELRVRGLTEKLAPEELFAALKNLSKHRGISYLDDAEDDNASAKTNYAKSVLANKELLKTRTPGQIQWERFEKYGQIRGDFDIVTPEGEQQRIINVFSTTDYKKEAEQILETQALYYPQISSEFIEDFITILTSKRKYYHGPGNEKSRTDYGRYRTDGTTLDNIFDILVGKCGIYPDEYRAAKASYTAQEFNFLNDLNNLTLPTETKRLSTDQKKDLVRFATTAATLGPDKLLKEIARMVGCSKDDIKGYRIDNKEKPDLHTFEAYRAMTKLNTFDVATFSREMIDELARILTLNTDREGIEEAIVNDFPNLFSREQIDELIQFRKSKSQLFGKGWHSFSLKLMSELIPELYATSEEQMTILTRLNKMSPERKVTLRTKYINEQDATEEIYNPVVAKSVRQAIKIINECIKKWGEFDQIVIEMPRDKNEDDEKKRIADGQKANAKEKASATEFAASLYNGKKELPDEVFHGHKQLATKIRLWYQQDGKCLYTGQDISIHDLIHNQNQYEIDHIMPLSLSFDDSLSNKVLVLATANQEKGQQTPYQAIPKMKSAWSYREFKAFVLDCKRLSKKKREYLLTEEDIDKIEVRRKFIARNLVDTRYASRVVLTTLQDALEVMNKETKVSVVRGQFTSQLRRQWKIDKTRDTYHHHAIDALIIAASSQLKLWKKQDNPMFEEYEQGQKINLETGEILSDDDYKKLVFQSPYQGFVHTISSKSFEDEILFSYQIDSKVNRKISDATIYATRQAQLSRDRKKETYVLGKIKDIYSQTGYDAFRKRYDKDKTVFLMYQKDPLTWEKVIEVILRDYKEFDDKGKEVGNPFERYRQQNGLMTKYSRKNKGTPIKALKYYDNKLGNHVDVTPDDSKNPVVLQSINPWRADLYFNPKTAKYELLGLKYADLSFEKGTGNYTISQEKYDEIKKREGISAESEFKFTLYKNDLLLIKDIENGEEQVFRFLSRTMPNQKHYVELKPYDKAKFDGGQSLLTVLGTVAKGGQCLKSLNKVGISIYKVKTDVLGYQHFIKKEGNQPKLSFENSIKRHKNK

SEQ ID NO: 1050 - protein, 1406 aa, Streptococcus ovis
MAKFNQKYSIGLDIGVSSVGYAVVTEDHKVPSFKFRVFGETEKKYIKKNLIGSTIFESAEPAQDTRLFRTSSRRLERRNNRIKYLREIFKEEIDKVDKNFYRRLDETFRIVDDKSDDIRIKHPFFGKKDLEKEFHQQYPTIYHLRKYLADMPDTEEKADIREVYMALSHILKYRGNFLTTRDINPNNIDIKEKWKDFVLACQECFDMELPDGYEEFYTVLKEKLARKDKVKTMVSLFPKEESKKDTSVFKQLLHLLFGLSTKFKVCFELDEEPDLDFLKENYDEKLSELLCVISDDFSNVFACLKSFNDTLLLSDMLTHKGGTHARFSATMIDRYEEHRKDLQRLKSFVKQNLSEQDYLDIFGKKTEKGFVVDKEIRGYAGYINNKTKIDDFYSYLSNKIKMLEGADYFLDKIEHKTLLRKLRTVDNGAIPNQIHAYEFVKIIDRQGKNYPFLLENKEKLLKILTVRIPYFVGPLAQKDGSRFSWYVKNEAPNVLDSDDEDTKAGKIRPWNIDQLVNMNETRKEFINNLIGEDTVLLNKKVLPKRSLIYEELMLHNELTRVKYKNKYGKTDSFKSDVRKAIIKDLFKDTSKRVTVKQLVNYLQNCHDELKVVEIVAGVRQSFNASLKTYNDFKNIFSAQMLDSEEYQNELEEIVKIITVFEDKKSIKDYFKKNFSNFLSDEQIDQLSKLRYKGWGEYSQELLTNIRDEDTGFNLLQFVRTDDRNRNLQQLISDDKLSFKHKISEIQSQSLQSDTLSESIKEIAGSPALKRGILNSIKIVDELVDIIGYPPQKIVIEMARENMTTEEGKKKSKPRKTKLEQALKRMETDLLVDNGKNKGQLKYSNEELQSEKLYLYCLQNGKDMYSLDKDGNPETIDYNQLNQYEVDHIIPYSHLPIDSIDNKVLTRRINNQNKEANIPNKDIVRKMKPFWEQLYEAKLISQVKFQRLTTAERTPNGVLTEDMKAGFIERQLVETRQIIKHVARILDGRFESSKIVTLKSQLVSNFRNTFHLPKIRELNDYHHAHDAYLNVVIAQTLLKAYPKLAPELVYGQYRKFNRHEENKATVKKHLYSNVMKFFNSPETKVSKEVWSCSRDLPIIKKVLYKSQINFVKRTVIKKGGFFNQNPVGQNSTKLAPENLYPIKQGLNPSIYGGYGPLNSALSVLIIAEKMNNRTNKTKLVKELHDIDIIDYKRFNENPIDFLNSPEFLSKNDFSRVKNYIQIPKYSLVQQANGGKMMIESSTNLHKATQFKLTESQSELFYHMKRYLTKSNLMDLKDEMAVKESVNFIEQHSDEFDKLAEAIFNFSRKYLGETAGLKSLESGYNNRNFKDFQCNDEVVRYYYENFLKMFEFVKSGVSRDIKTYFSEKNSVARPRYKPNSKLLSATLIHQSITGLYETRIDLSKWGEE

SEQ ID NO: 1051 - protein, 1021 aa, Thioalkalivibrio
MNTRLALDLGSSSIGWALFRLNDDSRPCAIIRSGVRIFSDGRDNYQNSLGARRRKKRLERRMRARRNKRVRTLARWLITLGFLPSDPVERRLLMNELDPYELRSRGVREELTRFEFGRAVFHLGKRRAFKSNRKTDTEDEKESNMKSAITTLEGELQKSGTTLGDWMYQQRKKDSSFSLRFRPNSSSSASKLDYDYYASRAMVEDEFRTLWIEQKKRSTHPEDFSDWAFDRIFDAIFFQRPLKPVVPGLCTLIPEERRAPKALPSFQRFRLYQELNHVRLVSADGARRPLSLGERDKLALYLENHKTLNILSIPRKLKLKDGSQAINLSGEDGSKKELTGNRTACDLRGNGKSKPGFGVAWDNFSDARQEEITKKLLNETDAESLSGWLVRNTGVSPDLAHTISERSLESGYSRVSEKAISLVLPKLMESVIPYSKAVEESEIGSHSGLSHYEKTGVLLEELPYYGEYLQRRTDGGTGDPRETNPEIRFGKIGNPSVHVALNQLRKVVNELVREYGRPTEINVEVLRDLRHGRKTKKKIHLANLENQKENQRRVEEALPFLGVKKVKSLSDHKRSSVARKMRLWEDLAKNPGDRRCPYTGTLIEPQMFLKTGEVEIDHILPLSDTWDNTLSNLTLCTREANRKKGKQTPYEAFGHIDEGPYSYASIKKRVKSIRDPEKRRRFLENALDVWKEDHSGPSSRALTDSSYIARVAVEYLSLICPREKVIPVSGRITSQIRKRFNFKKGRHDHRHHALDAIALGIADHRLVQQSARTSREADGRYMSLAKFIREPWPTYEEHAERAIRNIVVSFRPDHGHQGQIHKESHWGLRGDGSAKRKGANKPKTPNDVTRMMSISKSSDPLRIHTGSPAKSGTAYKFMETNSNYCLEITVNAKGKWSGEVISRAKSYEFMRDHPGGNIMDVLPKNKGINGRPLVMRLTQGDMVRIHVDGNKHIMRVNKMGWNGSVFLSEHFESNCDQRNRGKAEPGFRYLTKSASGLQAANCEWISVSPAGRTSSRWHAAA

SEQ ID NO: 1052 - protein, 1071 aa, Yoonia vestfoldensis
MRLGFDIGTNSIGWWLYATDGNEITGVIDGGVRIFSDGRDPKSKASLAVDRRGARAQRRRRDRYLRRKAALMKRMAAAGLMPADPVAAKALEQLDPYALRASGLDQELPLTHLGRALFHLNQRRGFKSNRKTDKGDNESGKIKDATARLDQAMIAKGARTYGEFLHMRRASAPDPKCVPTVRTRLSIAPRDNAEKAEAGYDFYPDRRHLFEEFTKLWAAQAANSPDILTDELRDEISVIIFHQRPLKTPEVGLCLFSGSHGVPQNDKRIPSAHPQNQRRILFETVNNLKVAARGELARGLTRDERDTIAHALDNKAHTKSLSGMSMKLKALGKLIKLRPEQSFTLETANRDSIVCDPVRASLSHPDRFGSRWSTLDAEAQWDLVQRIRAVQSDAEHNALVAWLIATHGLDRVHAENVANAPLPEGHGRLGMTATKRILAALEAEVIPYSAAVAACGWHHSDGRTGEVLTELPYYGQILDRHVIPGTYDENDDEVTRYGRITNPTVHIGLNQLRRLVNKIVTVYGKPDEIVVELARDLKLSEDQKRDVQRDIKKNTEAAITRGQKIEELGYANTGANRVMYRLWEELGPAIGPRCCPYSGKPISASMIFDGSCDVDHILPYSRTLEDGFSNRTLCLKEFNRQKTNKTPWEAWGNTPAWDAIEANLKNLPANKAWRFAPDAMERFEGENDFSARALKDTQYLSRIARSYLDALYDGADGKSHVWVVPGRLTEMLRRHWGLNSLLPDKDGAVKAKNRSDHRHHAIDAAVVAATDRSLVQRISKMAQRDEVNGAEEVARSVPPPWDDFRTDIKSQLDRIIVSHRADHGRIDFAARQTGNDSTSGALHEATALSIIDDQNVAVRIPLLSLSAAQFEEGGRSGWVRDPQLRGALHLATKGKDKKDFEAALLSFAAKPGPYHGISRVRIEKPLQDTARVYVPADAPIKAYQGGSNHRYEVWKLPDGKVLHHVVSMFVAHQGNLTRPHPAAKRIYQFMKGDLVRLEDSKFGPVIATVEKFNGKGMIELVPHNEANASDRYRKTKEDLYIRLGATTLLRAKARRVHVDEMGRLRDPGPPQ

SEQ ID NO: 1053 - protein, 1116 aa, Woodsholea maritima
MTEKYKPLLFAFDLGTNSIGYWVYALNSKGEPESSKGGGVRIFSDGRDPKSKASLAVARREARAMSRRRDRYIRRRKALLRTLSEYGLMPRDAKMRRALVQETGDIAQKSGGGSDGPYELRARALDEKLPLEYIGRAVFHLNQRRGFKSNRKTDRKDNDLGKIGAGVRDLEAQIMASDARTYGEWLAKRRRAGQTVRLRAGSDLLTAEGYAFYPSRALLEAEFKAIWAAQAQYYPDILTSEREKHVFDIIFYQRPLKPPQVGKCAFNPKETRLAKAHPVFQAFRLYKEVNELEIVLDDLSHQKLNRAQRDKLIWLLRQKKKLSFAKLRTELKLPRTTTFNKESETRKDLVGDEVYVLMADAKRFGGQWADFTLEEQWAILTKLKEEEDPERLLDWLQAHYKLDDDQAIAIIDAPLPQGYGRLGLTALSAMLDALKEDVIPEAEAAKRCGYNHSRLGFESEAGEDCLPPYQEVMERHIPPGSGDEDVVELELKDSLRDGLKEGPIPIGYDLYKGRITNPTVHIGLNQLRRLVNDLLVKHGKPQSMVLELARDLQMSEKQKTEYNKAQAKNRREAEARGSLLQEMGQRNNGSNRVLLKLWEELNPKDPEGRVCIYSGQAISASMLFSGEVDIDHILPWSRTLDDSKANLILCISAANRQKRNRAPAEVTEWQSHYDEILARAQILPKNKRWRFAADAMARFEGEEDFVARQLTDTQYLSRLAKEYLECLYPFEEADEHGELKKRNHVWVTPGRLTEMLRRNWGLNSLLGDQDHAEVAQPKNRQDHRHHAIDAAVIGVTTRALLKHISGLARTVDSQNFDYAIKKIIADNPPWPSFREDLKAALQPIVVSHKPDHGRVSQAGYKLGKGQTAGQLHNDTAYGPTQETDAKGNPIVVRRKAFNSLVAKDIPNVRDERLQAELYSAIEGLQKDKDIAEALAVFQKTHKQFKNIRRVRVAETLSTIPIRDSDGKVFKGFKGDSNYRYDVWETLDGKWHCEVVTMFDVHQRDWTSPFHKDHPTARRVLRLQQNDMVAYNHPDKGYCIARVVKFGGNGQIFFAPHNEANTDNRNRDKDDPFKFFSKTASGLKAIQCRQIRISPSGQIFDPGPQDQESKAQKRQIA

SEQ ID NO: 1054 - protein, 1427 aa, Empedobacter brevis
MAKNILGLDLGTNSIGWAFVKEATNSNEESSIEKIGVRVNPLTTDEQTNFEKGKPITTNAGRTLARSARRNLHRFKLRRENLLQILKTHKWIDNETILAENGNKTTFETFRLRALAAEKQLELHELVRVLFQINKKRGYKSSRKVNNAEEGSLIDGMEIAKKLCHENLTPGQYVLDLLKTGKKKVPDFYRSDLQTEFDRIWNFQKQFYNELFTDNLKEELKGKGKVATWTILKVPFNLVGLKRNLKRDELKLENYQWRNDTLSNQLNLEQIAIVLQEINGQLANSSGYLGAISDRSKELYFNNQTVGQYQYAQLQNNPHARLKNQVFYRQDYMDEFEKIWEIQAKNRENIFTNTLKEEIRDVVIFYQRKLKSQKGLISFCEFEQREIIKDEKKKTVGLRVIPKSVPLFQEFKIWQILHNIKLKNKITNEVVLLNENDKSFLFEELDLKGNLTASEVLKLLVDKPKDWEINYASLEGNRTNQALYNAYLTILDNEGYDVREELKLKLNKDDITLADIDKSASGIKEMVRAIFNHLGIKPEILDFNAELEGKAFEEQLSFQLWHLLYAYEEDNSPTGMDTLYRLLEQKFGFNKEQAKVMGTVAFQDDYGSLSSKAIRKIYPFIKENEYSVACDLAGYRHSKNSLTKEELENRELKSRLDILPKNSLRNPVVEKILNQMVNLVNTIIDIENDKLEKAGMKRNFQFDEIRIELARELKKNAKEREEMTKAMNAGKIKHEKIINILQVEDGIKFPTRNDIIRYKLYQELKNNGYKDLYTNQYIERKDIFTKKYDIEHIIPQSRLFDDSFSNKTLVPRQINLDKGNKTAYDYIFDVFGQDKLNEFLIRSKALFDLNDEGISKAKYKKLTMKGSEIGEGFIQRDLRDSQYIAKKAKEILFQITKSVLSTSGSVTDRLRDDWDLVNVMKELNLEKYRLAGLTEMQITKDGNPKEAIKDWTKRNDHRHHAMDALTVAFTKFSFIQYLNNLNARRNDKYDSISNAKDKKAIDTNSLRISSKDALGIEEKETHKINNGKGNYKRVFNEPIPNFRQLAKEHLEAVLVSHKAKNKVVTRNINKTKGSDKIQIALTPRGQMHDQTVYGWNRWSRVDLSKKLSKIEIEAIIDLKKRQFIKDFISEKGSISKAFTDENLAKLIFNNKSLKEIEISIPCYTQKIDLNKVLTDTQKTISAKKKVIKNILDLKVREKITERLVDYNGDFKKAFSDLDQNPIWLNEEKGIAIKRVTISGVKNAEALHTKKDHLGNDIFDEDGNKIPVDFVSTGNNHHVAIYEDEKGNLQDRVISFYEAVARINQGLPIVDKAYNHHLGWTFKFTMKQNEMFVFSSEDFNPNEIDLFDRKNQTLISKHLFRVQKFSKVEYGNSAVRDYVFRHHLESVISDVKELRDKTYKVFKSLGEFKGLIKVRTNHLGEIIHIGEY

SEQ ID NO: 1055 - protein, 1042 aa, Methylovulum miyakonense
MGKKVLGLDLGSNSIGWALLAEEDGKPNRIINIGSRIFIKAVEEKTPTPKNVKRRNARLTRRVLQRRAKRKLRMLKFLISLKLLPDDLQSSFTPEIELNAIGNPYPLRAKALDEPLTTYELGRVLLHLVQRRGFLSNRKTLLGDMADDPDVLAVLAELEDEEDNSTERAKEESAFKEQIKNFRNVIAAANCRTLGEYLATRDLHECQRNRSHDGGHLRTDRQMYHEELDKIWEKQQNYHTVLTDDAKKQIDHIIFYQRPLKLRADRIGKCSLEPKRTRANIARLESQRFRYWQDINNLQYFENHTDQWLSLNEAQKTKLAQLFEHQASISFAGIRKALGFDKTIEFNLERGSKKLKGNITACEICRVFPAWDSFNDDQQHALVEDLLTIQKKSVLKNRLEKHWHIPPDIAVQLCLLEFEPGHSNLSVKAINALLPFLQQGQIFSDARVSAGYGYERQEIIPLAKLPAPPETANPIVNKGLHELKRLINAIIAEYGKPDAIRIEMARDLEMNTKRYAEHDKQQKANTKANDEATNKFQEMRQQNPHLQLRNYPGKTDKIKYRLWKDQDQRCAYSGKAINLSTLFGAEIEIDHILPYSESLDDSYMNKVVCYNQENRFKGQKTPIDAFGKDESKWNQITQALKRWDRRLQSKKNRFVMTAADVQKRDFISSQLNDTRYISRVALDYVKQLGADVSVSKGITTAWVRHQWGLNNLLGEGDAKDRSDHRHHAIDAVVIACVDRRFYTALVGIAKDLERKQSQLNMKDIHIDPLWPSLREDLQQALSQVIVAHAPQLKLSGELHEVTGAGFIEGIGNVNRKNLDGNFTQVDKIYDAAVKEQVEQHLKRFGNKPKEAFAEGNVVLHKDGKTPIKRVRIVQSKTTLAKLEKSKFGARDKQGKVFKWLAYGNLHHVEILRDKQSGKYSGEFVTMMEASHRAKGIGKPKQPIAKNDHGEGFEFVMALHINDIVSIENGGQRVFYRVQNLDSHNKRMQLRLHTAASSKTQDKAKDKARDQATTLPDKDSTIPALMALGLQKHKLNILGKVIA

SEQ ID NO: 1056 - protein, 1080 aa, Methylocystis sp. ATCC 49242
MRVLGLDGGIASIGWALIEIFEDHEPSDGRIIDTGAWMFDAPEEKSQTGTKLKSELRRIFRGQRRVIRRRRQRMNEVRRILHRHGLLSSDNRDALKQPGLDPWKIRAEGIDRLLSPIEFAVALGHIARHRGFKSNSKGAKTSDLDAESSRMKKAVGETREKLARFGSPAKLLVEDEGFVLRQTKLKSGALETVRRFRNRDGDYSRSLLRDDLAAEVRALFRAQARLQSTFAKVELEAEFTQAAFFQRPLQDSERLVGPCPFEPAEKRSPKRGYSFELFRFLSRLNHLTLREGSEERTLTVEELRTAAADFGGVAKFTFSTLRKRLALPDIAIFVGIKADDEKKLDVVARSGEAATGTARLRRVVIDALGELAWGALISAPERLDKITEIITFRSDLDRIRAGLIEAGFDTPLIEAIVRAAADGKLDAFTGVGHISAKAARNIIPGLMRGMTYDKACAAAGYDHTASRERDAFDVGMHGKEALKKILQEERISRELVGSPSARKALIEAVKQVKAIIEKYGVPDRIHVELARDVGKSIEERRDIHFGIEKRSRQKDKLRELFGKEVGHLPQDGERGKEELLRFELWNEQMGRCLYTDEYINPKQLVASDNSVQVDHILPWSRFGDDSYLNKTLCTAKANQDKKGRTPYEWFRADKPEAEWDAFVARVESIQFMKGLKKRNYKLKNAEEAAEKFRSRNLNDTRWTCRLLAEALKQLYPKGEKDKDGKERRRVFTRPGALTNRLRRAWSLQRRKKSEKGERIADDRHHALDAIIVAATTESLLIRATREVQDIERKGLHYDLTKNITQPWPGFADEALDAVEKVFVARAERRRARGKAHDATIRHIAVRDDEAKVYERKKVGDIKLGDLIRVKDAERNAPLIENLRKWIEAGSPRDNPPLSPKGDPVSKVRLVTKNKVNITLDTGNPERLATVDRGEMARVDVFRKANRKGKYEYYLVPIYPHEIATMETPPMRAVQGGGDDDKWPEIDSTFEFLWSINQLSLLELTKPDGEVIRSYFRSLDRNTGALTVSGIANSTATRKGIGTRTLIDFKKLHVDRLGQIFEVERELRTWRGETWRGKDCI

SEQ ID NO: 1057 - protein, 1146 aa, Hugenholtzia roseola
MNQKGYFVLGLDVGTNSLGWALLDLVSQKIIAASVAVFAAGKNKTPTGKEESRNAVRRLKRGMRRQFFRRRQRKAALLEALQILGWIEKDLPKQGKAWEKWLALCPYQLRAEALERKLTLEELARVFYNLALKRGFKSNRKALSEEEGSKKEEDTETKKTTKKAKSDKKEDAKPSMEEMLGATRKALAEGGFQTLGQYLYSLQKIESPQAAGLKPKIRGNHRAERKLYQEEFDRIWQAQVGFFAAQEIDLNQHSRFEDVIEKVVAGRFQNEVRSKGLAYLFKEYLVFFQRPLKSSRHLIGKCTLFPTKKRAAMSHPLYQKFRIWDKLAHIRLTGAGMQNEPLSMDDRHKIVQKLETVEKQTIKQILKLIDKSDYQTNFKETDIVMGNKTALKMRKIFDPPKPAAKNAKNRKERNQLFGIVPQSEEADFYQSWDSFSEEEQIEIWNAIENIAQDNEWLAEYARKKWQLSEERIQILKKTHFEAPYGRLSVKALRQILPYMENEGMDFSNACAAIGLSHSEGIGAQNQDFLGEVPNLRNPLVQRSLSVIKKVVNEIIKKYGKPNEIHIELARELKLPLQAREKIDKQNRDRAAEHERIKDTLQNDFKIISPSRQDIIKYKLWKECDETCPYTGDKIRKSELFSHTYEVEHIIPYSRSLDDSFGNKTLCRTDFNRKKANLTPYEMKEKGLIKAPEYEAMLERVRNFKPFSAKKFQRFTKNITDFTEGFENRQLTDTAYIGTETRKYMLQIAEKETDVILTNGGTTAELRRLWGFNSILKDEETDEKKRDDHRHHLIDAIVIALTNRSLIKRLADENQVSDKLKALLSTKDQDKRFSYPKGWESLRHEVKEVAENALVYHHFRKRKRGTLHDDSLYGRAYLPFSGKPKEDEKGQPYYTIRKKVEALTIPELSKIADKTIRLMVFQKLEEGGISKEVLDNLKEIDKRENTLRKKLKKESPPNYEERAEPKTTMERIKEVLQNLSLPSKNPYFQSVPIKKLRIQNPENTFVFVKGRKAYVAPNGNHHLCIIEKADGKRRAEMITRFAANTRKGETFAPPPLAKGEKLLMTLMLNELLLVESPALSLEGLDLETANKQLLNQHLYRVKKMSGVTITMRHYLSAKDDSTVFSKSSNELKARKVRISPTGEISWA

SEQ ID NO: 1058 - protein, 1120 aa, Propionimicrobium lymphophilum
MSHEIDYKVGIDVGTNSVGFCALQVDANGMPVKLLSSMVKIHDSGVDPEKVKSAVTRLASAGFARRTRRLYRRRKKRLAELDRKLVELGMPIIDLESLPDPYAPWKARLLLVQEKLEASEQKRELSIALRHIARHRGWKNPYERIESLYHVQEDSDLFEDLKKRVSEKTGAVFVGGETLPEVLSHVGFNASERLRSAPSVKYGQRSLIDGENVEGETKDGIIGGKLMQSDNANEIHKIAQVQEIPDEIVKTLIDLVFKAESPKGSASKRVKKDSLPGQNNKPRAEKAHLSFQRFRIVSVIANMRLIDPENGELRKLNAAEKSKLIDFLMLPDDSDGITWGDVAEILDVPRECLQGTSKLAPEGERASSFPPVNVTHSRVTKCGVKPIVEWWEEANFEEKNALITLLSNADELDPDVPGADSANKLMESLSDKQLENLDKIKLPAGRAAYSIDSLDRLTEKMISDSLELHKARKAEFGVPDDWRPPSDPIGEPVGNPAVDRVLKAVNRWLLAAEREWGAPLSVNIEHARSGFTSESQVREYERDLKRRRERNQRVVSEANRKLGSQMVERRSDITRYVSVRRQNCQCAYCGEPITYQSCEMDHIVPRKGPGSTNTRDNLVAVCVRCNRAKTNIPFAVWVESTTIPSVSVKEAIARVRYWIKDEGLTLKQQRNFQNDVINRLKKKSADEEIDNRSIESVAWMANELHARVKGHFESVGAETKVTVFRGAITAEARKATGFEGKVNLIDGHVKTRFDRRHHAMDAAVISLMRPSVAKTLAERSNIKQSQRITRRAEDWKNYRGRDEGSRNIFDRWSRQMDQMLVLFNIALAEDAIPVTQDVRLRVGNGRAHDDTIRPLAAKRVGDSWTLQEIDRAATEQMWCALTQQSDFDPVEGLPENQLRKVRVKNIFYEANDELRILPKQIAAIPVRNGYAEIGNTIHHARIYKFGSKKPKYGMIRVFTHDLLKNKSDDVFTVELKPSSVSMRNAESSVRKAVLKGEAEYLGWLVTGSELELDLSDSYFSQKAIGELLKDFPETNRWVVSGFDSNKQLKLRPRLLAAEGSEKVALNDGSKVIICDKGWRPSVNLLFSKASFLRKICRPALGRERTKSDSGLPISVTLKES

SEQ ID NO: 1059 - protein, 1347 aa, Streptococcus plurextorum
MQKTYSIGLDIGTNSVGFSVVTDDYKVPSKKMKVNGNTDKKYLKKNLLGTLLFDSGETAAGTRMRRTTRRRYVRRNNRLRYLQEIFADQMEQIDPNFFHRLKESFLDEEDKQFEQHPIFGTLAEEVAYHQQFPTIYHLRKHLADSKEQVDLRLVYMALAHIIKYRGHFLIEGGLESQAVGIQQLFDEFVQVYDSVFEGSDLVSIHAEVEPILVDKLSKSVKKDRVMQLFPTEKSNGNFAEFMKLIVGNQADFKKVFSLDEKAVLQLSKDTYEEELADLLGKVGDDYLDLFHAAKRLYDAVLLAGIITSQDIATKAPLSASMVQRYEEHQSDLKALKKHIPNYKPDERKLYKEMFNDSTKNGYAGYIEGGVKQEEFYKYTKALLSEIENSQYFIDKIEREDFLRKQRTFDNGAIPHQIHLQELKAIVRRQGEHYPFLKEEQHKIEALLTFRIPYYVGPLARGNSRFAWAVRKSNEKITPWNFEEIIDKEESARKFIERMTNVDLYLPDEKVLPKHSFLYEKFAVFNELTKVKYITEQGKEEFFDCHLKREIFEQVFKNSRKVKKKDLLNFLDKEFEEFRIVDITGLDSEKQEFNASLGTYHDLKKILDKDFLDDVANEHLLEELILTLTLFEDREMIRKRLSKYSEALTKEQLKKLERRHYTGWGRLSAKLLNGIRHKATNKTILDYLMDDGQINRNFMQLIHDDGLDFKTIISEAQVIGERDDLKAIVDDIAGSPAIKKGILQSLKVVEELVSIMGHNPESIIIEMARENQTTQKGRKNSQQRLTGLTNSIRELGSDILKEFPVDNSQLQNDRLYLYYLQNGKDMYTGETLNIDQLSHYDIDHIIPQSFIKDDSLDNRVLTSSKSNRGKSDSVPSQEIVQKMKPFWKKLRDAQLISKRKFDNLTKSERGGLSQEDKAGFIKRQLVETRQITKHVARILDERFNQKRDDNNKLIRDVKIITLKSNLVSQFRKEFELYKIRELNDYHHAHDAYLNAVVGKALLAKYPQLEAEFVFGDYPKYNSYKERMTATQKVLFYSNILNFLKDGNKHGNEDGEVIWDPNYHLPMIKKVLSYPQVNIVKKTEIQTGGFSKESILPKGDSDKLIRRKNNWDPKKYGGFDSPTVAYSVLVIADVAKGKAQKLKTVKELVGITIMERSAFEKNPIVFLESKGYQNIQEKNIIKLPKYSLFELEEGRRRLLASAIELQKGNQLVLSQEQINLLYHAQRVKNLEQPEHLRYVEEHKAEFEVILNTLLIAAERYILKPKVIEMIKKALESNQLDITQYAESFVNLLKFTAFGAPGGFKCFGIEIKQANLRYQTVTECLNATLIHQYVTGLYETRIDLSKLGGE

SEQ ID NO: 1060 - protein, 1203 aa, Rubritepida flocculans
MAGQQGGGRLLFGAMVAKVQDPRAQREGQGALHPRDAQPAPVWTTCFACGKRPANQTSHRPHQASLHDGFITPFEAAFQGGPLMQIVWGFDLGVTSVGFAVIRWDGWATAEGAGEILRLGVRMFPEAREIDTQGPGDPLNAARRQKRLMRRQIRRRRWRRVHLRAVLAEAGLLPGADAAPPPGQDPYALRARGLKDGLAAEEAGWAIFHLLKRRGFQGSRKVGPAEADVSPGAEQAARGHRRGSDASPSDPADRRAQEDAEAQARGAALAARLAGRTLSAYLQSDDHLKPAGTAPPAWEIPRRRGVGQTRPMVREEFEALWAEQAKHHPDLLTPELKSRIETAALAQQPTFFRARTIGEDDLEPGEPRALKAEWLTQRFEMLQLVNALRLERGNQRPLDPAERASAIAYLESVRRPTWAGLRAAIGIGRSDRFTHERSEKSTLRGNATEAALRAALGAAWDALPEQTRKTIRAEIGRAWHRIEYRPLKGGAIFAIRDHLDIAKERATLAARARGEWGLPAEAAEALARIDLPDGAARHSLKAMRRLLPHLEAGLSYMTALEREYGARRESGPPLQRLPVPNRAELARIEDAWVRERMAALLAGIRNPTVLRTLGELRKVVNTLLRAHGRPDVIRLEFARDLKQSVEERRATDKRQRDRERARRAAREEVARLGKPADGPEGEENVLRWLLWREQGGRCPYSGEQIGCAGALDASATQIDHIFPVSRSFDDSQANKVLCLAGENAAKGRRAPFEWLSPDGDRWNHLTSIVWPSMEQAGWPAAKRRRCLKPSLEDPLADEVGFTNRQLVDTAFIARAARPYLGLLFGGGQNGIDAVQPVPGRATALLRRAWGIGLGRLIGGASEDGPKVRDDLRHHAVDALAVALTTPRTVAELSRWWQARESGLRPPGFRLPWPGFRYEVKAAVEAILVSHRVQAKLSGPLHEDTRLGDTGLREASGSAIYVKRKPVAELSASEILSTPQYGRDAWIADGGVRQAILDHLSASGLTLERRERGTVPDQAAARRLRALLAQEIRLKLTEEARKRWAERGVAAERGPVIRRVRLHIRRKEGIMRVHAEKNIHAELGPGSNDHIAIYRDGETVRFLVATKREALMRVQRGEPTVLLEHPQGGRLVMALRPRDVLSREENGIREFVLVRKVNAAGRIFYKPLYSANEPRPEVSLGPSFVKDGWQKVSVDPIGRWRPAR

SEQ ID NO: 1061 - protein, 1512 aa, Flavobacterium filum
MAKILGLDLGTNSIGWAIVEYYKENNIQFKLQDKGVLVFDAGVLKDDKGKYKSKTSERTNFRGIRKLKLRLKVRKYETLKVLIENEMCPLEMQQLDVWKKSNFTIYPCSETFLDWLKTDDKSHKNPYYLRNKATKEKLSNYDLGRVFYHLAQRRGFLSNRLDKTDDSKIDNLKEKLKIYVEESDLTTLKLEFENQFIDFELEGRKDLDPTETKIKNIKSKIYKIINNKDIKYSEIDTVKKEINDYLNKPETSGPVKKGIKELDTLLEENKFDTIGQYFYSIYNKEFNIVKEGEKELIVKNAKIRNHYTGRKEHYLKEFNIICQKQEIDKKIKDALIKAIFFQKPLKSQKGMVGYCNFQINKRRCSLSRPEFEEFRMLQFVNNIKIKTPVDEKLRKLTDEEIIKVKKQFYRKTKPTFDFKDLVDELIPKDKTAIYFKNKEAKTAEYLVNYKLNATVSGCPTISNLISIFGQEWKSFEVVTDKLNSKGKYIKYNYIDVWHAWQTFTDAKKLESFASEKLKLDNVKAAKFSSVSLKTGYSDLSLSAIEKINKYLAKGLLYSHAVFMANIENVIKDEFWNDLNKRKEIEFEIGSIIDTYSLEKKYSNAVNDLLSKYYEDKENRVYYSKEAKQIFRKDLWSKFEDVFGRKAWNNNDDKDEYFEYYFNLMLKNLELRKRIKIETLEEKVKNYLLSFEYCDENDLKKLYHPSAIEKFKAKLLKDYDGKAYKDENGNDLLGLGSPLNTSIKNPMAMKSVHQLRKLINTLLIEGKIDKSTIIHVETARELNDNNKRKAIEEYQKERENLRAIYKQKIEELYFKETGSTINPNDDDILKFQFALEQREDKKIVTKEEILKYELWKEQNHICLYTGKTIRLSDFLGENPKYDIEHTLPRSLSQDNSMENKTLADAKFNRDKKKQLLPCELDNSEDVLLRIGHWKNRYISLDKEIEILKKKGSRITDKDKKDKNIQERHKLKMEYNYWYGKYNRFVMQDITDGFKNSQKVDVGLITRFAQNYLKSCFEKVYSVKGTMTDEFRKLWAKDVFYKEENGKLEKNRDNHTHHCKDAVVIACITKDKYDLLAKYWEKEDENKKEEAKEIIRNTIPWKGFAHDLKEIEETVLVKHIKKDVMKVTTYKKLRKKGKLLHIPEYVKDENGEIKLDANNKKIKVTYKHPETGKEIIVYQKDNEGKPLPIIQKSDSARGSLHKQSFIGAVAKRMLDENGKPLQINGKYILQKDSKGNVEKLYVMRKEITKLNASDIEKIVDSNIKMIIQKAVDNKILKFKKEGATIEKDCIIWQNEEKKIPIHKVRLFVKDTPIEIKQQPKQNLQTNKANRKIHKHLIYAQNDDNYMIALYKDDKHKDFEIVNNLDYINLKKENQGFYPTSKIKKVRGKEVIIPIINRNKKDLILKKGQIVIFLEKGEVINDLNTISLLEQRIYKIEGISRQYDKKNDNEYGVLNFKKYDEARKSDTAKKDDYSEDGEFKLNENKPTRKMSHNQFNAFVEGIDFMITPIGKIQKL

SEQ ID NO: 1062 - protein, 1232 aa, Rikenella microfusus
MAKVLGLDAGTNSLGWAIVEETETGYILEDKGVHIFQEGVARDKNNEKPAVQDRTDARALRRRYFRRRLRKIELLRVLVRYGLCPPLTEEQLEAWREKKRYPLDAAFLRWQRTDDNAERNPYHDRYRALTETLDLSDERHRHALGRALYHLAQRRGFLSNRKEAGNGKEEGAVQSGIENLSAEMEKAGCRYLGEYFYQLYRRKEKIRKRYTSRNKHYLAEFNAICERQRLPEEWRKALHRAIFFQRPLKSQKGSVGKCTFERKKSRCPVSHPRFEEFRMRSFINNIRLTAPGDDTPRPLTRLETETILPLFLRKSKPHFDFEEIARRIAGKGQYGCQGDRNEAPYRFNFARTATVSGCPVTASLIALFGDDWLPEICRLYRLGEGKSEEQVLNDIWHALFSFDDEERLRAWAADKLRLADEQAKAFAAIRLPQDYAALSLNAINKILPYLRRGYRYDEAVFLANLKAVLPPATYADETRRLRIERDIAELTLESRREPYVKYDSKERRIDDYLTDQGVPPARLNRLYHPSMIETYRAARPDAQGLLLLGSPRTASIRNPMAMRALFRLRTLVNRLLREGKIDPDTKIRIEFARGLNDANQRKAIEQYQREREAENRKYADEIRAQYAAETGLTIEPSEDDILKYRLWEEQKHVCPYTGKQIRVSDFIGSAPGFDIEHTLPRARGGDDSQMNKTLCESRFNRESKRTKLPAELSNRAEILERIESFGWREKVESLQKQIEAQFRKGRNAPTKEERDSAIQRRHYLRMQRDYWRGKYERFAMTEIPEGFSNRQGVDIGIIGKYARLYLKTVFRRIYIVKGSTTDAFRKMWGLQEEYARKERINHVHHCIDAITIACIGPKEYDRWARYAADEERYRYGAGARPRFDKPWPTFTEDVKAVADELLVSHHTPDNMAKQTRKKLRVRGRVKLDAAGRPICQQGDTARGRLHQDTFYGAIRHQDKLRYVIRKSIGDLQPADVEKIVDETVKARIKEAIGEVGFKTAMNPDEHTIWMNREKGVPIRRVRIFANITQPLPWDKMQRDLSVHEYKRRYHVANDGNYCMAIYEGTDSKGRTKRSFEIVNLLDAAGYFKASADRTARPDLVPRTNANGHPLKYLLKTGTMVLFYENSPAELYDCPPKELAKRLYKVTKMAKNGQTAFMFHQEARNDDKLKTDYAEKFGTTAPKALTNGYSSVDYQQPHPKLLLSPSSFDMYVEGYDFELTVTGQIIFKHETPC

SEQ ID NO: 1063 - protein, 1399 aa, Chryseobacterium tenax
MTKNILGLDLGVSSIGWAYVQEDDKNSANNKIIKLGVRVNPLTVDEQINFEKGKPITTNAGRTLARGARRNLQRFKLRRANVIDVLTKGNILKDGDLLTEVGKNSTFQTQELRAKSAKEKIELSDFVRVLLLINKKRGYKSSRKAKNEDEGQIIDGMAVAKKLYEESLTPGEYSYQLLIEGKKQLPDFYRSDLQSEFDKVWKFQKQFYSEILIDELYKELQAKNKNATWAILKEPFSLVGIKQMGTMQEKKIEKYLWRSEAAKKQLDFESLAVVFQEINSNLNNSSGYLGAISDRSKELYFNHMTVGEYLYQQLKANPHTKLKNQVFYRQDYLDEFEKIWETQSQYHSELTKELKEQVRDVVIFYQRKLKSQKGLISICEFENREIEIIENGKTKKKTVGLKVAPKSSPLFQEFKIWQVLNNLQFQNLETKEIFPIDLDFKQSIFDEVNVKGRLSAKEVLDIVGYSGKEWKTNFKDIEGNNTNENLYTAFLKIIANEGKEFPKEFKLTIEDDIKVTKIHSSASKIKEFVKENFSSLGINTSILDFNPEFDGKDFEKQSSYQLWHLLYSYEGDDSASGNEKLYELLEKKFSFKKEHSKILAEIGFSPDYGSLSSKAMRKICTYIKEHKYSDACNLAGYNHSKNSLTKEQLANRILKEKLEILPKNSLRNPVVEKILNQMINVVNEVSKEYGRPDEIRIELARELKKNAEERANMTSEIGKATLLHQKYAEILQKEYGIKVPSRNDIIRYKLYLELANNGFKDLYTGQKIEKENIFTDKYDIDHIIPQSRFFDDSFSNKVLVPRGANLKKGNATAFDYLEMEGKDQLEKFLNTIKDLFDKSLISKAKFEKLQKKGSEIGDGFIQRDLRDTQYIAKKAKEILFEITNSVVSTSGRITDKLREDWNLVNTMKELNLDKYRKLGLTETVINSKGEEKERITDWSKRNDHRHHAMDALTVAFTTHNHIQYLNHLNARKDEKHNQHIIISNIENLITKVYEKKNGSTKRKFVEPIHNFRIEAKKHLDEILISHKTKNKVVTKNINKTKKKGGVVAKVVLTPRGQLHKETIYGSSKFLKTKEEKVSGKFDLETINKVQNEKFRIALLERLKEFNGDSKKAFTGKNVLAKNPIYLNEEKTEQVSESVILAWYEKAYTIRKAVNSDNFKDYKNLEKVIDNGVKEILKNRLDAFKGNAKEAFSDLEKNPIWLNESKGIAIKTVTITGINNAETLHYKKDHFGKEILDENGKRIAVDFVSTGNNHHVAIYEDADGNLQERVVSFYEAVERVNQGLSIIDKEYNSGLGWKFLFTMKQNEMFLFPSEDFNPKENDLFDEKNLSLISKNMFRVQKFGELSKSGFWFRHHLETSVELKKELRSTSYLDFYSKDFMKTIVKVRLNHLGKIVQIGEY

SEQ ID NO: 1064 - protein, 1064 aa, Veillonella magna
MKYILGLDIGITSVGYGIINEQYEVITSGVRLFSEGTAAENVIRRTSRGIRRRIRRRRHRLDRMKQLLCTILNIGTIHFETDIYNIRKKGLYERLSPSELAAAILHLTKRRGIHYLTAEDLEENNTSGQTTKDIVDGNTKQLKDKYVCEVQLERLAAGQSVRGIENKYLDVSYKKELEALLDKQSNFYPELEANRDILISIYESRRDYEEGPGGENSPTPYGRYRYDKEGKIQTVNLIDLMRGHCTYYPEELRIAKNSYTACLFNLLNDLNNLKIDGSRKLTYEEKKELIDTIVNRGKNINLTQIAKICNVVKDTISGYRVDKNDKPLFTKFEGYQELYNICKTLGCINIIEGNRNLVDTISDVLTKVKDLDEREHQLIVMGLEKSIAHALAGAKKFKEYHSLSKKAMEVILNDLWRTDKNQMVLFLERGLSPRQELDVTSNEIKFSMENWIVSPVTKRSVNEAIKVINALRKWLKKKEGQSAEFSDIVIELAREKNSADAANREKRNQKNQEDKKKKLANLAPSRHLTKKQMDMLLLLDEQDRKCAYSLRPIDIQDVFTEGMLEIDHVIPRAKSLCDAMYNKVVVYSSENQNKGKRTPFQYFCSGKATINYDTFKEWVIGNNRFSKRKKACLLYEQDPDKDLEGFINRNLVDTRYASRKIMNVLQYFFKCHGFPTKVKSINGAMTFAFRNQARLSKDRLNTYAHHAQDALIVAGFANTNIVKKLDRFLPQARVINENGIEEYVDVSTGEALSDNDFYSPEYIQFIKYISNITALRPKYSHKVDRKPNRQLYDANIKSTRVVQDEKEENTFYITKYSNIYDNGPGNNGSKLKAMILNSPEKLLMYRYDKKTFDKFLEVVDYFKDESNPFYAYYKEYGEKLRKYAKKDNGPVINDVKFLDKKLVSHRVNGKQQGKNKSVYLKIKSWRADIYKSGEKYKLINVTYDMLIPTHGKLETTYTINKDMYERALIAKNLKEEDFCFSIYSGEKLSFTKNGEEQTWIFSCVNRDSTNRIEVKYVDKPSPGNTQKYRMIAIGAVSNFKKYTTDVLGNDYPVSKEYIKYTVKI

SEQ ID NO: 1065 - protein, 1075 aa, Azospirillum halopraeferens
MQPYRLSLDLGTNSLGWCVLDLDHDGQPRGVRRLGVRIFTDGRNPQDKSSLAVARRLARQMRRRRDRTVVRRTRLMAALIRFGLMPADRAARKALERLDPLALRARGVDERLDPHEIGRALFHINRRRGFKSVRGTGDPEEAGKIRPAIGRLEARMADTGAPTLGAFFAWLRANGHSVRARPVGRGARAEFPFYPARPMLEAEFDALWAAQAPHHPGLLTEEARATLRRRIFHQRPLKPPPVGKCSLIPEDRRAPRALPSAQRFRLLSELANLRIIAPDRSERPLSMEERDAILRAARAKPAKKAISFKDIRKVLKLGSEVEFSHESARRPELATDETAAVLSDKRRFGPRWARLTPAEQDEIVERLLSEPEEGALIDWLIARPGLEPEAAARVADAPLPDFHMSIGRRALAALLPVMETHAVDGRPIRYDEAVPVAFPGLHHSDRRPGGRLNALPYYGAVLDRHVAFGTGDPKDPVEKRLGRLANPTVHIGLNQVRTVVNALIDRYGRPQEIVVELARPLKQTAEARRKADKEQADNQKKNEARKELLRRAGASVNGRNLMKLRLWEEQGSGVARRCPYTGRTIGLELLLSEKVDIDHILPFSQSLDDSAANKVVCLTEANREKRNRTPYDAFHHDPARWAVILGCVEDLPPNKRWRFAADAMQRWDADGGFLARQITDTQYLARLAREYLRHVCHPDRVRVSPGRLTALLRRRWGIDSILRDHNRDGGEAPADGAVIKNRNNHLHHALDAAVIGCIDQGLVQRVAQAAQRAEDQGLDRLMDDLDPPWPGFRDELAARVRAVTVSHKPEHGTGGRLHEDTAYGPTTESERAEGFNLVFRKPLDGLSEREVARIRDPLLRRAMQDRVAFHRAGPERLDVKQAVIRAAEDLAATEPWVGVRHVRLLTKEAAPIWLAGPDGEPYKGLIAGDVHHIDVVALPDGRWAGRAVTLFDARRTALPDGRAAPCVPAPGERFVMRLHKGDLMKLEHDGRERIMRVARLEPANNRLRMAEHSEAGELDKRHADPDDPFRWLIISFDVLRRRRARRVTADPLGRVRDPGFPKWAVEPGPDGEAVA

SEQ ID NO: 1066 - protein, 1395 aa, Lactobacillus jensenii
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 1067 - protein, 1066 aa, Desulfovibrio termitidis
MQQVPYILGLDLGAASIGWALLAAGNDGEPVGVLRSGVRLFEMGCAGDMDKFQRGKEESPNAARRAARQMRRQHRRKARRRQRILVLMQKYGLLPPGNVRDTNARNAFFNTLDAALLDQWLNRHAASCSPAEAERLSCDPDFLHVFPYRLRADGLTRPLSAHEFGRAVYQLAQRRGFLSNRRTEAEEDEELGKVKTSINGLQAEMDAAGAETLGQYLAGLAPSVSRIRGRYTSRDMLTQEFDLLWERQRALHPAPYPAHLREAARNALCDAIFYQRPLKVQANLVGFCELEPGERRAPKYADEAQEFRLLQRLNDLVWYDKQLVPHRLADNPEQYARLRDAMLRADSMTFPAMRKLLGLPQDSRFNLEEGGEKKLFGHRVNARMHAVFGDAWDDFAPEKRAAILHDIISMDDARALCGRGRRAWGLSEEKAVQFARPLPEKGYASHSLKALRTLLPAMRAGESYGTVRPCLYPPRYGDAPQDTLPPALEAMSTLRNPVVLRCLTELRKVVNAIVREHGKPVVIRVELARDMKRSRKERTDYSARNRKQESQREKMAERLMSPEAGNARIATPRRNDVEKLLLAEECGWQCPYTGRMIGWNDLFGPHPQFDVEHILPYSRCFDDSFLNKTLCHAPENRAHKRGRTPHEAYAADPERMDAILRRVEAFQGDAATCRAKLARFRAPTMQEWKDFADRQLNDTRHASVLACKYLGLLYGPQSNRYVQASRGGITAMLRGLWGLNRLLGDGGKNRGDHRHHAVDAIAVAATSRGMVQALQRAAAQAESGRVNRLVPRDMVPLPFEGFMEQADNVVLSILPSHRVSRRVRGALHNETIYARRELPDGAVGYAVRKRLDDVGKGKPVGQDAANTFTAKLLDPGLAPSVALLLTGSVPRRDDDGSPPPVRSVRVLQTGTPVSVGKDGRLCQTASNHHAPVYAVPGKKGEEWVCPGVVSLLEAMQRKEAWKKSEGGPVVDRQGPEGARFLFTLSSGECIRVRVDGRDEYLRVRSVYMEQGVLKVEAVRLQDARPKKEIGKKREGGFFKLSLKQLQQGDCEKVVITPLGTVVPCRD

SEQ ID NO: 1068 - protein, 1134 aa, Methylophilus sp. 5
MNSKQGVKYSIGLDIGIASVGWALLGEHRVIDLGVRCFDKAETADKGESLNLARRSARLLRRRLRRRAWRLTKLARLFKREGLIADVNVLKQPPAKGFATPNLWQLRVEALDRKLSAEEWARVIYHLCKHRGFHWQSKAEEKKADDDKEGGAVKKGLAGTKKLMQDKGYRSAAEMVINEFPDAQRNKRGDYSKALSRELLSSELHMLFESQRTFGNPNTSSEFENKLLESKHGLLWAQKPSLSGEALLNMLGKCTLEKNEYRAPKGSFTVERHVWLTRLNNCRLIIDGEKRALTPAERALAINLPYDQSSDFSYKQLRNALVKAGLTSEFRFAGLVYPSQSEQEKSKNPEDEKLIKLPAWQQLRKAMKEANLESDWQKIAVDALDGKAQLYDGIARILSVYKEDDEVERELNKLDLPNKPDMVAVLQTFRFEQFSNLSLKALYNILPHMEKGQRYDEACLAAGYHHSQQHVISTGEYRYLPPFYSGRDKDGRLKFNEELDIPRNPVVLRALNQARKVVNAIIKKYGSPDQVHIEMARDLSKSFDDRRDIKKAQDEYRDRNEKDRSTFNLEFNTTGELKGREFEKWQLYREQHGKCAYSLQALDMNRLFEMGYAEVDHALPYSRSYDDSKSNRVLVLAAENRNKGNMTPYEYLGGAQNNVRWIEYVAFVNSNKTYRQAKRNRLLRKDFGEEAAKEFSERNLNDTRYICRFFKNYVELYLKLADESDAKRCVVVNGQLTSFLRARWGLVKVRSDSDRHHALDAAIVAACSHSMVKRLANYSRRKELEAAREGFVDLTTGEIANHAMYAQLEQHFPFPWSHFRQELQARLFADDLQAMRNELENMGYDADALDHAKTLFVSRAPQRRNGGAAHKETIYGQSEKLATTGSVTQKIVVTDLKLSDLDKLVEPHRNQKLYAEIAEWLKGKDEREKRVKEIETSLGRGKDKREMTAEEKAEVERLRALPRKPTNDGSPGPVVRTVTAVIDKLSGIPIRGGVAKNDSMLRVDVFSKAGKFYLVPVYVHHRVTGLPNRAILQAKDEAEWTLIDESFAFKFTLYPNDYVCLIQKGKSPLYGYYAGCDRTTGNIDLWSHDRNRLIGKDGLLRSLGVKTAISLEKYNVDVLGNIYPAPKETRSDLA

SEQ ID NO: 1069 - protein, 1513 aa, Asinibacterium sp. OR53
MNKKILGLDLGTNSIGWALILQDFENKQGEILGIGSRIIPMDQGTLGKFAEGSSISQTAERTSFRNARRLRERYLLRRERLHRVLNILNFLPEHYVSQIDFEKHLGKFKEETELKLTYKNKEFIFKTSFDEMLADFRQHQPHVLVNEKGKPKLVPYDWAIYYLRKKALSKKIEKEELAWILLNFNQKRGYYQLRGEEEGDNPNKKIEFHSLKIIDVIADEIQKDKTDIWYSLILEHGWIYRRQSKTPLFDWKDKIRDFIVTTDLNNDGSIKTDKEGKEKRSFRAPGEDDWTLLKKKTEQEIDQSGKTVGAFIYDTLLQNPNQKIKGKLVRTIERKFYKEELRRILEKQIELQPELFTSDLYSDCIRELYRNNESQQSSLSKRDFVHLFINDIIFYQRPLRSQKSSISNCSLEFRNFKDENGNKQKQYLKAIPKSNPYYQEFRIWQWMYNLSVYKKDDDTNVSKEFLSSIGDMENLFDFLNNRKEIEQKPLIKYLLEQKGLKGKLLNAEVEKFRWNYVEDKQYPCNETATLIREKLTKIKGISENFLTRGIEQSFWHLVYSVTDKHDYEKALKSFAAKHSLDEDSFVDIFRKFPPFKSEYGSFSEKAIKKLLPLLRVGKYWNWDTIDKEVQIRIDHIIDAEANDEIRQIVKEKADKHQLRARSDFQGLPLWLAQYIVYNRHSEADISEKWNSAKDLEDYLKSFRQHSLRNPIVEQVITETLRVVKDIWVKYGNGTKDFFNEIHIELGREMKNTAADRKGITNQITENENTNLRIKSLLAELKNDPQVENVRPYSPMQQEILKIFEEGVLNADIEIEEDILKISKTAQPSSSDLKRYKLWLEQKYRSPYTGEMIPLNKLFTPEYEIEHIIPQSRYFDDSFSNKVICEAAVNKLKDNQIGLEFIKNHHGEKVLIGMDKVVQVLEVEDYEDFVKQHYAKNRSKRNKLLMEDIPEKMIERQMNDTRYISKFISNLLSNIVRSESNDDGVNSKNIIPGNGKITTELKQDWGLNDVWNELILPRFERMNQLMNTTHFTTWNENHQKLLPAVPLDLSKGFSKKRIDHRHHAMDALVIACATREHVNYMNNEHALRKGKTKEEKQTIRYDLRTKLCDKKHNKDSDQNYEWIFKKPWASFTADAKSALEHIVVSFKQNLRVINKATNYYEKWVDKNGIKVKELQEQKGTNWAIRKSMHKDTISGLVKLKKKKTVSLNVSLDAIADIVDEGLKKEIQKLQKVGWDKKKLSKHFKDLNYKWNEKDISKVEIYYWEKDNVASRVPLNDTFDEDRIKDTITDTGIQKILLNHLKNYKGQSDKKGKEIPAQLLAFSPEGIEEMNKNIMMLNGGKFHQPILKVRTYEPKGNKFNVGQTGNKKVKFVEAAKGTNLFFAIYTDENGNRTYETIPLNIIIERQKQGLSSVPLQNETGEKLLFQFSPNDLVYVSSENDKQSNIQPTFDSRCIYKVVSFTNNRLYAIPHIVAKSIVDKNEFTQLNKLETSLDGLSIKEHCYKLKTDRLGNISKL

SEQ ID NO: 1070 - protein, 1247 aa, Alkaliflexus imshenetskii
MKKILGLDLGAASIGWAIISEEIETDKTRVEILGMGSRIIPYEGTEGKDFAKGTGESRNALRTKARTIRKGYDRYQLRRKYLVEELIKNQMYPDDVLRHLPKLQLWELRSEAVHSPVSLKELGRLMLWLNQKRGYKSSRSDANLGKKDTDYVAVVKSRHENIKELNYSIGQFFYKELLADNSYKVKENIFPREAYIEEFDAICKTQQVAHSNVLTNELIKKIRDEIIYYQRPLKSQKGLVSVCEFEGFWRKGKDEKEYFVGPKVAPKSSPLFQLAKIWENINNIKIGSRTGGEINITNEQKRAIFQHLDNNDKLTSSDLLKILKLKKDECYVNKQLTKGLTGNITKHAIRQCLGDLAAKYDNLLKLELDINVLPNEGYLYDRKTGEVLGSKPILVIDPKVEYEPLYQLWHTIYSINDKDECSRVLQLKFNIEKSVADQLAAIDFTKHAFGNKSAKVIRKILPYLMDGDGYTDAMSYAGYNHSASQTKEENLQRQLLDYLKPIQKNSLRQPIVEKILNQMVNVVNSIIEKYGKPDEIRIELARELKQSKEERNDADKSMSKRQRENEFIAKRLEEYGLRATRNNIIKWRLYEEMDNQDKKLNAICVYCGQPISLTQAIRGDEVDIEHIIPKSKLFDDSQSNKTLAHRHCNKTKNDLTAYDFMKSKPEAVFNEYVVRVNYLYANHIINKSKRDKLLMTESKIPDNFIDRQLRESQYIAKKAREILQTICYNVWSTSGTVTAELRHLWGWDDVTMNLQIDKYRELGLTHFVEWESDHGKNKHQKEVITDWTKRDDHRHHAVDALTIACTKQGYIQRFNTLSASKTREDMFAEIEKRSLEFKEKRSLLEKYIIGEQPFSVLDVEKAVASILVSFKAGKKVAVWGKRKAGKRGNKKVVQDRIIVPRGALSEQFVYGKIKRQEPDRPIKYIFENPHLIFKPKIKAKVEERLSIFDGDVRKALASLKNDPVYLDENKEVVLEKATCWKDEYVLKYPVDINFNKIDKVVDTKIKKILQNRLLKFGEKEKEAFKDVQLEDKTIIKWYEHEGLERPIKSVRCFTGLAAVVPVKKDENGKDIGFVKPGNNHHIAIYTNAEQNKHQHISTFWHAVERKKYGIPVIIKNTNEVWDLIQSKPEGTYPTSFLEMLPPPNFKLLVSMQQNEMFLLNMPEELKENLDLNKKSTLSNYLYLVWSLSDNDYWFRHHLETKNSELKSVVGAKESNRFYRFKSLSSFFSTNPIKVRLNNLGDIIGVVQ

SEQ ID NO: 1071 - protein, 1483 aa, Prevotella sp. HJM029
MKTILGLDLGTNSIGWAKVIVDDNENYLRDIQLGSRIIPMSQDVLGKFDKGVTESQTAIRTNFRGIRRLRERTLQRRERLHRVLHTLHCLPPHYDSAIGWDRKTPTTYGKFLNHGEPKLAWERRGDGTMQFLFMDAFHEMIADFAKYQPALVANGKKVPLDWTIYYLRKKALTQPIKKEELAWILLNFNQKRGYYQLRGEEDEENAAKHEEYHELKVVGVEADEAGKGDNTWYNVKLENGWIYRRQSKIPLNDWVGKVRPFIVTTEYEKDGTTPKKDKEGNVKHSFRSPDEKDWGLRKKQTEHSLEASGTPVGAFIYDHLLKEPSDKIRGKFIHTIERKYYKQELTGILREQSKHHEELRSKDMLKACVEELYPNNPLHRESLLKKDMPYLLIEDLIFYQRPLKSKKSLIAECPYEAYSYVDKETGEMKRQGIKCIAKSNPYYQEFRLWQFIANLRLRNRADDRNVTAEYLPHQEDYVRLFTYLNDRKEINQETLLKDFFKLKKVTIGGEKVFPIRWNYIEDKEKKYPCNATRHELLFALDRAGIEHNWLNDRDLAYRLWHLLYSVDSKDETERALRKLKDDDAFVESFLKIKPFEKEYGAYSEKAIKKLLPVMRRGSLWNEADLCPSTKERIANILQGTIDEKLKKKIGVFISSCQQVSDFQGLPEWLACYVVYGRRSEATDIQRWETPEQLLDYIHKFKQYSLRNPIVEQCILETLRTVYDIWKEAGHIDEIHVELGREMKKTAEQRAHLTEKVLRNENTNLRIKSLLMELKNNADIKDVRPHSPMQQEILRIYEEGALQTLSKEDAAFTEITKISKMAQPSASELKRYRLWLEQKYRSPYTGKPIALSKLFTSAYQIEHIIPKKRYFDDSFSNKVICEAEVNREKGSMLAYEFIKKRGGDVIHCTTLGDVTILSEAEYKALVTELYANNTSKKEKLLMEDIPQEFVNRQLNDSRYISRVVMTLLSNIVRIEGEEETTSKFVIPCSGGITDKLKKDWGLNDVWNNIVYPRFERLNALTNTTDFGQWENKEGKRVFQTSVPLELQRGYQKKRIDHRHHAMDALVIACASRNIINYLNNKEANDPTKQENARKQLCIKNRIIRKPWETFTQDAYKALDNIVVSFKNYVRVINKATNYYERYNANGKKVVDEQKGEAMWAIRKPMHQGTAYGHVNLRRKAVVKLKDALENIPTICDKTLRHYIQDLQKKHFNTKQLLAHFKSINYRLNKQAVDKVEVWQYSDDKEKLAATRKPLDTSFDAKRIATITDTGIQKILLNYLQAKGGDPAIAFTPEGIAEMNQNIAIYNEGKQHQPILKVRIAKPMGKKFPIGQTGNKAFQYVIAEEGTNLYFAIYEDEEGNRTYDTIALREVVERLKQGLTPVPEKSEKGVALKFYLSPNDLVYVPTADELLSKACSLDKNRIYKMVSATMNRCLFLPHRVAKTIYDKVEFEALNKMERALTGEMIKPICWKMEVDRLGHIVNIIK

SEQ ID NO: 1072 - protein, 1082 aa, Clostridium beijerinckii
MMKEDVNYRLGLDIGITSVGWSVINLDKKRIEDLGVRIFNAAENSKDGASLALPRRLARGRRRLFRRKSYRVDRVKKLLMEANILITDKNILIREEREKFFAEFFKKCKTKSGLDVWEARVKALDEKVTNEEWAKILINLCKKRGFKSNRKNEANDKETGQVLSSIKSNEEKMKSLQARSVGEYIYKEVNLSNDSYKGFRNKVGQYNMCVSRAMLMDEIITLFARQRELGADFASEEIEKKYLEIFNSQRPYSRFEDLEKMIGFCTFEKKNKIKRASKNSISAEEFVLYENLNKLSIVNKGDKRKLTSEERNLAICEAYKKNEIKYTGLRKLLNLNDEERFSTLSYSNKVEIAKTENTKFVSLKGYHEVRKAIETNLGKDRWLEIKDDRNMLNDIVYVLSIAKTDEEIEKQLNLREISEDIIKSVSDLSFSKFINLSITAIEKIMPYLKEGYQYNEACDKAGYDFKAVYEGTKLIKLPKIGIDEIVNPVVNRALAQTRKVINAVIDEYGSPIGINVELARELAKNFKDRKTIEKEQKENRDNREKLRNQLKDLMGKEPTGAEILKYRLWSQQKEECAYTQERISIEKLFEPGEYEIDHIIPFSRSFDDSMNNKGLVKGTENQRKGNRLPYEYFGEDEERWHNFEIWVEDSNLHPKKKYNLLKKKFSKEEQREFKERNLNDTKYICSYISNFIANRLIFKESESKKKVITINGRATAYLRAKWGLTKVREDGDKHHALDATVVAVATQGMVQEISKYSKAKELNYIRQGDDFVDIDTGEIVVLEDYRYLLKDRLPRPWLGFSEELITRLSDDPAEELKKSPIKTYDEDFIKNTVRPIFVSRVPYRKIGGKLFKETIYSPKAFQGKTFVTKRNLTELTPKDIDNIYNYQTDKKLYDAIKCKLIEHNGNAKKAFEEEFRKPTKDGKLGPVVRSIKINATVPFKDGIDLNGGKVAKEGIVRVDIYEKCGKYYSVPVYRNEIAKGIIPKKAALAASDESNWTVMDESYNFKFSVYKNDLVEIIYEKKRGYFGYFDGFDRSTASFTIESNDSSERYRGIGIKTGVKEINKYQVDVLGRYYKVKKEDKN

SEQ ID NO: 1073 - protein, 1231 aa, Prevotella loescheii
MITRILGLDTGTNSLAWAVVDRDANGNYTLVKRGDVIFTEGVKIEKGIESSKAAERTAHKALRVHYSRRRLHKIDTLKVLVELDLCPYLSNEQLNLWKAKKTYPLTDDFMLWQRSGSAEENNPYYCRHRCLTQKLDLTDQSQRFLLGRAFYHLAQRRGFLSNRLDTSADSDESGKVKSGIAELSVEMEKAGCEFLGEYFYQLYKQHGNTIKLRSRYTDREEHYKKEFLAICEKQELDPKWVEALQRAIYFQRPLKSQRKGVGKCTFEPKKPRCAESHPDYEAFRMLCFLNNVKIQTPNDTSLRPLNEDEREKIWPLFFRKSKPNFDFEDIAKALAGKNNYAWYKDAGEKPFKFNYRMQQGVSGCPVTAQLIDIFGSDWQTAIAETYTAVEKKNGTKTIDEMADDVWNVLYSFSSKDKLKAFATEKLQLDEASATKFANAKLPHGFASLSLKAIRNILPFLRQGFIYAHAVHLAKIPDIVTKAVWNDADKREMILSGLMEIIENYNPKDRGVEGTIDFCIKSHLQDVIDLRPGAADALYHPSMIETYPDAKLNKMGVFQLGSPRTNAIRNPMAMRSLHILRSVVNQLLRDGIIDRNTEVHVEYARELNDANKRKAIADYQREQEKKRKQYRDDIIALYKSECHKEIEPTDTDILKFQLWEEQDHLCLYTGTQIGICDFLGDNPKFDIEHTVPRSVGGDSTQMNLTLCDATFNRQVKGAQLPSQLSNHADILVRIDHWKSKCEDLRKQLDKIRTYGGMEKAMKDRLIQKRHRLKMDLDYWQGKYSRFTMTEVPEGFSRRQGAGIGLVSKYAGLFLKSLFHNEQNPNKSNVYVVKGVTTAEFRRMWGLQGEYEKKSRLNHCHHCIDAITIACIGKAEYDKMAQYYHDEELFQWRGTTTKPHFNKPWPTFTEDVLAIEQSLLVKHLTKDNMPKQAKKRVRTATGKYLAQGDTARGSLHKDTYYGAIEQDGEIRYVLRKPLNKFENEAELEKIVDQAVKEKIKEAIAGKNFKTAITEPIFMNKEKGIRINKVRYYVKAQERLKIRQQRDLSSKEYKQFFCVENESNYLLAIYEGELKGKKERDFCVVNNLESAACLKRSNKGKAAPLVPERSEERNLPLLAVLKRGTQVLFYENSPEEILFDNPQDLVRRLYKVTGINTKKDVKNGKTYLYGNIELRFHQNAQKKDDVKMQSGVYKNNEVLRQGIVLSHKQFKALVEGVDFEFNVLGEIKKKERHA

SEQ ID NO: 1074 - protein, 1344 aa, Kandleria vitulina
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 1075 - protein, 1399 aa, Chryseobacterium sp. YR485
MNKNILGLDLGVSSIGWAYVHEDSKNFENNKIIKLGVRVNPLTVDEQLNFEKGRPITTNAGRTLARSARRNLQRFKLRRSCLIDVLKKNNILSETDLLAEVGKNSTFQTQELRAKATKEKVELSEFARVLLLINKKRGYKSSRKVKNDEDGQIIDGMTVAKKLYQENLTPGQYSYRLLQEGKKQLPDFYRSDLRSEFDKVWNFQKQFHPDIFKEELYTDLQGKNKNSTWAILQEPFSLVGIKQTGTAQEKKTEKYFWRNEAVKKQLDFESLAVVFQEINSNLNNSSGYLGAISDRSKELYFNNQTVGEYLFQQLKANPHTKLKNQVFYRQDYLDEFEIIWDTQSKYHKELTKGVKEEVRDIIIFYQRKLKSQKGLISICEFENREIAITENGRTKKKTVGLKVAPKSSPLFQEFKIWQILNNLQFQNVETKEAFPIDLDFKQSIFNEVNIKGKLSSKDILDIVGYSSKEWKTNIKDVEGNYTNENLYDAFLRIIVNDGIEFPKEFKLTIDDDIKISKLNVSAEVIKLFLEEKLSELGINTSILDFNPELEGNDFEKQASYQLWHLLYSYEGDDSASGNEKLYELLNKKYGFKEEHSKILAQISFPQDYGNLSSKAMRKIYPYIKEHKYSEACNYAGYNHSKNSLTKEQLENRVLKEQLDILAKNSLRNPVVEKILNQMVNLVNEIIKEYGRPDEIRIELARELKLSAEERANITSEINKTTIQHQKYAEILKKEFNILVPSRNDIIRYKLYMELANNGFKDLYTDLKIERENLFTEKYDIDHIIPQSRFFDDSFSNKVLVPRGANLKKGNFTAFDYLEIEGKEKVEKFLSIIKDLYDKGAITKAKYEKLQKKSSEIGDGFIERDLRNTQYIAKKAKEMLFEITNSVVSTSGRITDKLREDWNLVNTMKELNLEKYRKLGLTETVINSKGEEKQRIIDWTKRNDHRHHAMDALTVAFTTHNHIQYLNYLNARKDEKHKQHQNIFAIEKLITKVFEKKNGSKERRFIEPIKNFRIAAKKHLDEILVSYKAKNKVVTKNINKIKKKGSLIVKTELTPRGQLHKETIYGSSKFLKTKEEKVSGKFDVQTISKVQNEKFRNALLDRLQEFNGDPKKAFTGKNIISKIPIYLNDERTEQLPETVTLAWYETGYTIRKAVNPDNFKDYKNLEKIIDKRIRNILIERLKEFKGNSKEAFTDLEKNPIWLNKTKGIPIKTVTISGINNAEALHYKKDQLGNHILDEHGKKIASDFVSTGNNHHVAIYEDEKGNLQERVVSFYEAVERVNQGLTITDKDYNIDLGWKFLFTMKQNEMFLFPSEDFNPKETDLFDEKKLFLISKNLYRVQKFGELSKSGFWFRHHLETSVEVKKELRNYSYLDFYSKDFMKTVVKVRLNHLGKIVQVGEY

SEQ ID NO: 1076 - protein, 1088 aa, Listeria fleischmannii
MKKLVLGLDIGVASVGWGIIDAENGDVLDAGVRLFSSRDASENESRRTSRRQSRRLSRRKKHRRERIKQLLLAHDMDVCDIVNENPYQLRVKGLNEKLEISEIYVALTHLAKRRGVSYLDDVVEEGGAIKSEHLNKNMEEIKSGKMPCEIQLERFEKYGQVRGMIEINQDTEESSFLVNIFRTSDYIKEAKTILATQQKFHKQITNEFIDEYINIMASKRDYFIGPGNEKSRTDYGVYRTNGDTWDNLFEILIGKCSVFPEETRAARSSYVAQEFNLLNDLNNLKISSLESGKLSTSQKHDIVEKVKNSKKFGTKDLLKYIASVCECKIENIDGCRKDKNRKPIMHTFENYRKVHNALNEAGVDLRLSEADYDELMKIMTLNSETLEIKKQCKEKLPHLTEDYLNVCLVLNKKGAFSGWHALSLKAMKLMMPELYGTSKNQMQIIHTMQLGKAYIKPLNQQKYLNSEAILEEIYNPIAARSIRQTIKVTNAILKKYGPLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWKIFKDRNESHSHHAIDALIVAATANLRLWKKNKLGISDEGKVYDKETGEILPFEKLTASEYNEMMNKEPYLNFKTKLQNIETKVKYSYKVSKKVNRKISNDTIYSTRERDGIDYIVGKIKNIYDVKTYKDQFLKRYKKNKEQFLMYQHDPQTFAILESIMATYPDAENPFLAYKKEHGVIRKYAKNKAGAPVTSLKFIDGALGQKIDVTYKNKAALPKNKKVVLQSIKPYRADVYYDEGNKRYHLIGVKYSLFSFSKQGYVINPIAYQKLLEKEQIHSEMKFCFSLYREDIIESGEDPDSLTRYRFWSKNESGKNKIEVKPIEKPNFEDRKVITITKKIKILNKYQTDVLGNSFKAQEEKDPRSIE

SEQ ID NO: 1077 - protein, 1392 aa, Lactobacillus kunkeei
MKNYHIGLDIGTSSVGFAARDDENNLIRVKGKNVIGARLFAEGKTAQERRMARTSRRRYNRRKWRLRLLNDIFHDEIVHKDKDFFNRLKQSSISPKDDRKKYFGSLLFPELSDSEFYHNGNQTIYHLRHRLMTSNEKADIREIYLALRHIVKYRGNFLDDTPVSSFEASDLKLGSFIPTLNDLFETIDVNYVFNSENTNQIESILLNNDLRNSDKSKQLVDLLYRNVSDVDDKSLEKQFNKFRKDISKEIAKSFVGSKFNVNKLLAYETDDGSKISLSFSDASSDDKMLELADNLDDERINILNALKVIYSRVRLNQIIPNGMGLSESMIASYELHKKQLNDLKKLLNVLPFHEKYAVKVAYAAYIGNMDAQKFTQAELSTIESLKEKDSIKKVIDCKTGHITNESLISVINQIVVNPYLENSDFELIDIVKKIDQDIKNGEYLLKQRNNQNGNIPHQLHQMEMDQIIEKQSKYYPFLGELNPNENRRHIAKYKISELVAFRVPYYVGPLITPEEQAKTSGASFAWMKRKEDGEITPWNFDQKVDREATASRFIKRLTVKDTYLFNEDVLPDNSLLYQQFKVLNELNVVKVNNKRLSQAEKQGAFNDLFKVTKTVTAKRLKNYLVSNFNHLDTIEITGLSDGEKFNNGLTSYVDFQKIFGDKINNLELMDDFESLIEWSTVFEDRHIFEEKVRNEINWISESELKQLVAKRYSGWGRLSSKLLVGINNDEGRNIIEQLFETSETFMEAISRPEVKKQIDEINSDFIKNTDIESVLADAYTSPQNKKAIRETYKIVKDIQKAMGGKAPESISIEFTRNPEDKGELTRSRHSEISRKYKELSKEISKELNDELKSKKNSMDIDKYYLYFMQMGKDLYDGKSIDIDDLNNYQIDHIVPQSFYKDDSFDNRVLTYYTNNQKKGNNTPLNGLNISNETRKLWSHLHDLGLISKRKYLNLTMQGLDSLSKYTKHGFIRRQLVETSQVIKLVANILSDEFSADNTKIIEVKAKMNSQMRHSFNLYKIRELNDYHHALDAYLTTFIGGYLYNRYPKLRGMFVYGDFKKFDVNDANNVKTLNFLHDITNPSDKFVNQIYDEQSGELILDRKHAIETIKKIYQYKFMLITREVSTKDDKLSDQTVYSAKRINNVASPIPVKKDSNPELYGFRTGNVDHHMVIVKYPKKDSFVYKVVGIPIRFMQELRSSKNQSEYENTLNQIVQAKLNRKKFDFRVVVDNVMYGQLIQDGGQKFTLGSSTYRYNAKQLVLDMDSLRILSDEKYRNSLTDDEKNSEFINIYQQVLNVVNEKFDVFDVRGTRDKLTKGLDKFLNITSNDKEIVLLKILSGLHCNAARVKINEIGINTSFGELQTTHGIVLSENSYIIYQSPSGLFERKVRLKDL

SEQ ID NO: 1078 - protein, 1397 aa, Caviibacter abscessus
MKDYNIGLDIGTSSIGFAAIDDDNNLIRVKGKNVIGSRLFAEGKTAAERRGFRTARRRYNRRKWRLKLLDEIFYEEIIHIDPEFFNRLKQSSISPKDESKKYFGSLLFPDKTDSAYYHDGNQTIYHLRNRLVHQKEKADIREIYLALRHIVKYRGNFLDSTPVSSFEADNLKLDELVPVINDMYENIDIDFSINVDNISEIEKVLLDNHLKSADKQDRLKELLYDNPEYPDDKVKQKEISKFRKDLDKEIIKVIVGYKFNAYKIVNYIPDDGSKFSFSFSDESSDDKLDDLSEVLDDSQMEILNTLKVIYSRVRLNQIIPNGMGLSESMVAKYNRHHEQLEDLKELLDVLPNDEKRSIEYAYTAYIGNVDKQKYNNNLVASLKDLPIKGDINKKIQAVFEYAKGHISSQDLYDVIKTIIIDKYLEDESFEYHDLVERISNDIDNKDYLLKQRSSQNGNIPHQVHQMEMDKIIANQSQYYPFLGVLNPNESRRHIAKYKISELVSFRVPYYVGPLITPEEQEKTSGKHFAWMKRKEAGKITPWNFEEKVDKEATAAKFIKRLTVKDTYLLNEDVLPDNSLLYQQFKVLNELNIVKVNNKRLTLSEKQGVYNDLFKNTKSITVKRLKNYLISNYKHLENIEITGLSDGDKFNNSLGTYNDFKKIFGARIDDVNYSADFENIIEWSTVFEDRSILKEKLEKDIDWITPEEIKAVVAKRYSGWGRLSAKLLTELLDDDGQRIIDILWNDSITFMEAVSKPEIKAQIQNINRDFIKATDIETVLDEAYTSPQNKKAIREVYKLVKDIQKAMGGKAPSSISIEFTRSPEDNGSVTKTRYNNMQNKYKELGKELSDDLSAQLKEYKGRMDQDKFYLYFMQMGKDLYDGSTINLDDLNSYQIDHIVPQSFYKDDSIDNRVLTHYTNNQKKGNHTPLNGLNIDAQTQNLWKHLNKLGLISKKKLQNLCFKDINQLSKYTKHGFVRRQLVETSQVIKLVANILSDEFANDGTKIIEVKAKMNSLMRDTFNLYKVRQLNDYHHAVDAYLTTFVGKYLYKRYPKLRSMFVYGDFKKFSAEDDLKDIKTFNFLHDITNPKESNKEKIYDEKSGELILDRKHAIETIKKIYQYKFMLIVREVSTKSGQLFKQTIYSAKKTNGLKSAIPVKSNLEPSIYGYRSGNVDHHMVIVKIKKGTKYSFKVIGISARAIQELEIAKKIGNYRDKLYEVVSDRLSQSMKSVESFRIILDNIMYGQLIVDGNDKFTLGSADYRKNSRQLVLCTNSLKILKDEDYMNRLSDIQRSKLMVQVYDEIIKIMKNKYSLFISNTEKLLEKRDIFCGLSFDEQKIVIWKIIIDLHNGPFTKIQELGINNKMGTFQTKHGIILTENAIVIYQSPSGLFERKVRLKDL

SEQ ID NO: 1079 - protein, 1483 aa, Prevotella corporis
MKTILGLDLGTNSIGWAKVSLDDNGNYLHDIKLGCRIIPMSQDVLDNFGKGVTVSQTSVRTGFRGVRRIRERSLQRRERLHRVLHRLGFLPQHYDAAIGWDSDCAKTYGKFLDNGEPKLAWERQEDGSMRFLFMNSFYEMIADFTSHQPALVADGKKIPLDWTLYYLRKKALTQAIRKEELAWILLSFNQKRGYYQLRGEEEDENPTKREEFCELKVVAVEAAEKGKGDDIWYNVHLENGCIYRRSSKISLDDWVGKTKQFIITTEYEKDGVTPKKDKDGKEKRSYRAPKEDDWGLRKKRTETDLEASGKTVGAFIYEHLLAEPFDKIRGNFIHTIERKYYRAELEAILTEQRKYHEELRSEQMLAVCAEELYRSNLPHQQSLLKKDMVYLLLSDLIFYQRPLKSKKSLIADCPYEYYRYVDKETGEIKKQGIKCIAKSNPYYQEFRLWQFVLNLRLFDRMTDKEVTADYLPTKEDYVRLFDYLNNRKEINQETLLKDFFRLKKVKLGREKEFEIRWNYIEDKEKKYPCNETRYELLVALDRAGIDRSWIDEDGRQYRLWHLLYSIEVKAEAESALRKLNSDDAFVSSFLKVKPFKKDYGAYSEKAVKKLLAVMRMGSMWSEANICEETQNRIRSIIRGDIEEKIKERMGHTARSFNQIDDFQALPEWLACYVVYGRHSEVTDIQHWETPEQLQSYINGFKQHSLRNPIVEQCILETLRTVHDIWKEAGHIDEIHVELGRDMKRTADQRARMTKNILKNENTNLRIKSLLMELKKDTDIKEVRPYSPMQQEILRIYEEGALLQLKRDDEAFADISKISQMAQPTATELRRYKLWLDQKYRSPYTGKFISLSKLFTSAYQIEHVIPQSRYFDDSFSNKVICEAEVNRLKSNMLGYEFIKAHGGEIVHCTMLGDVKILSESEYKAFVNEHYVNHRAKKEKLLMEDIPQEFLNRQMNDSRYISKVVKALLSNIVRTEDEMDVTSKFVVPCSGGITDRLKKDWGLNDVWNSIVYPRFERLNRMTGTEAFGHWENKEGKRVFQTSVPIELQLGFSKKRIDHRHHAMDALVIACASRNIINYLNNESANSQKKREDLRRLLCDKNRIIRKPWESFTQDARVALQDIVVSFKNYVRIINKATNYYERYDEQGKKTTAEQKSSEMWAIRKPMHKETVFGHVNLKRKTTVKLKNAIENIPNICNKELKAYINELVEKHFNTKQMLAHFKSINYRWNRQNVEKVEVWQYSDEKERMAATRKPLDTSFDKKRIETITDTGIQKILLNYLEEKGGDPNIAFTPEGIAEMNKNISLFNDGKLHQPILKVRVAKTMGAKYQVGQTGNKAAKYVGAQEGTNLYFAIYENEEGERSYNAVPLNEVAERLKQGMSPVPEKNEKDVPLKFYLSPNDLVYVPTEEDKLSNECKLDNERIYKMVSATGKKCHFLPYSVANIIYNKVEFESMNKMGKALSGEMIKAVCWKLEVDRLGTILRVIK

SEQ ID NO: 1080 - protein, 1402 aa, Coriobacteriales bacterium DNF00809
MKLRNAKDYSIGLDVGTGSTGWAVTTLDGDLFTFNHRPTLGSRLFESASTAQETREARGARRRLKRRRWRISLLQEQFAAEMESCDSNFFIRLNQSRLWQEDRTEQGKGYLFGGKPILCGAQIFANEQEYYQQFPTIFHLRKFLVECSEQVDLRLIYLALHNIVKYRGNFLYQDNKTLNVRNFNLDSQIADFLDQLQLWCENNDLCFHEIDGTTTLASQLNTCFHQQSNQQKKDTLKTFFATCIENDKIAGELTKALLGYKTDFKIIFNIEGEKDEYKAKCNEEEKILKLQETIDDANQVLLQSILNLYSGIIVEKILNNTAVKNESAQCTLSAYHCYSYALYSKQLRTLKKLVRKYNPQRYNECFNLSAEDPKAKKQLCTYARYNAQHSTDYDEFKKYIKDLFENTDAVNDAAYQQMKQDFDEEKFLRRQKTSDNGVYPYQFHLEEMQLIIENQAQHYPFLTKIKPKLESLVTFRIPYYVGPLTQKGIQRNGRKFAWSKRNKDAENQRIYPWNWDSIIDKSASAEAFILRMTGKCTYLYGEDVLPKESLLYQEFCVLNELNGARWNCDGERRMPLSNKDCKAIYRQLFLKKQKVSYADVSNYLKAQGHINNSVAGGQGEHGFESTLSSHHFFRKLFNVDAANDLTAQQIETAEQLILWGTIFEDKEIFEQKIKERFGDMFSKDEIKTIARRKFSGWGKCSKQLLSGLTVETPRGRESIIDVLRNGHPENGRTLVFMQVITDKKLEFDKKIEEYNNEHLAKTNESVLDTAIMSPAIKRGVNQALHIVGEIRRITKHDPTCIYIETTRDEKDGKHNTRTSSRYSSLKKNLETLKSIDKANAPAIKHSLELLETYKKQNIDDKLFLYFTQNGKCMYSGKSLDINNLSSYQIDHVIPQSYITDNSFDNRVLVYASENQRKSDSLLLSSVIQAKQEPFWTSLEKAGLISEKKHNNLKRKSLSDAQIKGFINRQLVETSQIVKVLRDELSRILPDTKIIPVKASLSHDVRIACNLYKSRTANSFHHAHDALLASTMGRFVQTRFPDMYENPVRYVKILRAYIAQSKLQHSAQTRNFDSRSFMAHSFFCDYSNENGDTIWNSASEIERLRRALSYKNLYLTRRPFIDAGQFWDQTIYSPHDKKKTPDSLIPLKKNLDTQKYGGYSGKDYAHFFIYSVLNKQGDVEYRFDGVPLYIAANINRDDRGALAQYAKQLVEHENVPNAKRKTKDLVFQRIERACVPKYQLICISQCSGDSDRSVSDYYYITGKKEVRNALQLAFPMHLYGAINAIEDKKELDDSALEELVVYILRNAPRIAPDVFRRLNLTEKLADCLDIPDRIELQNSIYGLFNLINAESNVVNLQIFGGAKTAGVKLINLNSLLNDPATTVTFIDQSVTGMFERKETIGIS

SEQ ID NO: 1081 - protein, 1400 aa, Olsenella sp. DNF00959
MNLRNATGDYSIGLDLGTNSVGWAVTDSNGSMAHFKGKPTLGSRLFDAAETAAGARQHRGQRRRYVRRRWRLDLLQGLFQDEVNKVDSEFFIRLRQSRLHVEDRAEGHAGYRWPLFNDTDFTEKDYYKRFPTIYHLRKWLMETDEKADIRLIYLAAHNIVKHRGNFLREDNKNLSSHNANPAEAVRSLRQALDDWCAERGYVCAWTSVDDLAEADSHILDILTNSKERRADQAKELAKLFGVDCGDTKQSKSCNSALAKAVVGLKTELKDVFGEFCAEKTAIHLSSDDDVEAIRDAIPDDSGELFQVLCAVYSAYVLQELLSYAPGQTISANMVAKYDQYGKDLKLLKNLARTYVSRENYDAFFRGQTYEDSNDYNVDKAQGYTRYNLGTTKASYDDFKKSVEKLFKGTQAEQDKRYQGMMKRFAEEKFLRRLKTSDNGSIYYQLHLEELRAILKNQGKHHPFLLEEEKKIESLVSFRIPYYVGPLSSKNASLDHKGKQRFAWSERRPGMKDTVITPWNWDQIIDCDQSAEKFILRMTGDCTYLQGEPVLPKCSLLYEEYCVLNELNGARWTIDGDDWRRFDVAQREGILHDLFRKTRSVAYNKVADWLEREENWANAHVRGGQGENSFESKLGSYIFFCKDVFKTAALDEADYPMIEQIILWNTLFEDRAILKRKIEQAYGEHHGGKLTDEQIKVICKKRFTGWGRLSRKLLTGIKVDADTGRVSIMDVLREGNPNEGQRSRTMVLMEVLRDEDLGFQKKIDDFNKAYFAGQGEGLMSVNDLPGSPAIRRSINQAIRIVDEIASIAGKAPSNVFIEVTREEDDPRKKGRRTNRRYEDIKNALENFKTEDQELWSELLGKAPNDLDERLSLYFMQRGKCMYSGRPIKLEELHTGKYEVDHIIPRSYIKDDSFENKVLVCREENQRKTNEMLIDPAIRRRMGDYWRMLHKAKLIGDKKFNNLFMRDRIDDKTLKGFVARQLVETSQSVKLVQTLLEVRYPNTKIVPVKANISHDLREAADLVKCREANDFHHAHDAYLACRVGLFIQKRHPSVYANPIGLSRVMRDYARKQAGEFNKTHSMAHTKGFIVNSFMTSEFDKETGEIFWDAEAAVEDIRRVLNYRQCFISRMPVEDTGAFWDQTIYSPRSNKRLELPLKDDLDPNKYGSYSREQFAYFFIYEARDAKKSKTVLRFAQVPVRVTSAIARDSSKLDEYASGLAVQEGLEFTKIIRRRILKKQLLELNGDRLVITGAKEVRNATEFAFTLEETALVAMCSEIAREGVPSEIASDVQSISSQLSDLFLALIERGLTIGVRLHGQLKLGQYLRQFEDAALRDKAKVIIGIISITNGATNTLDLSSLNGSKNVGQVRITHNKLLNDKSTSYVLIDQSVTGMFERRTRIGL

SEQ ID NO: 1082 - protein, 1404 aa, Parvimonas sp. KA00067
MKGNIEKKKQEFNDYYLGFDIGTNSVGWAVSDLSYNLLRFNKKDMWGARLFDEAKTAKDRRVKRNSRRRLERRSKRLKYLEEIFETEICKIDKNFFRRLEESTLHNEDKTFDFRFPIFNDENYTDKEYYKDFPTVYHLRNELIKNENKKFDIRLIYLAIHNILKYRGHFIFEGQDFDSVTDFKEVFSELSAYLSENLEENLDINLCDNIKDIICSKENKTSKGKSFVSLIDSKVIQSVLRCCIGYRVKFKDIFINYEEKEKNEGINLSEIEYDEKRDEIALSLGENILLIDICKKVYDFMILNNILKGNKYISESKVNLYDEHKCDLCNLKYIFKKYLPKKDYFEFFRNENKEKNYVSYISSSLNNGKKKNTCTQEDLNKEIKEYIAKIKEYEENDAVLEKINLKLNENKLLPKLKTNDNGVIPYQIHKIELEKILQNQSKYYDFLLEKIDGITNIERIEKLFTFRIPYYIGTLKGKFSWAKLKENKKITPWNFEKIVDMEESAKAFIERMSNRCSYLKTENVLPKNSLLYSEYELLNELNKVKIKNEFINVVLKNEIIDELFKTTSKVTKKKFVDYLKTKQIFVEKEDISGLDNEFKSKLDSYIKFKKVIGDKIDTLRGYNFVEKCIEFKCFYGDDKKLFKNAINNTEFKDYVSDDELKKINKMKFNKWGRLSKRLLTEICFENVIESESFENIIVALRSTNYNFMEFTSKKFNLSEKVAEENQENTLEKFNINEYVDELYVSPSVKRSIIQTYKIAMEIKKITGKNPKKIFIEMARGGGEKGKKTEKRKERIKTLYANMKDSNEEFLNNLDNLKLSVDNYDDNRLREKKLFLYFMQLGKSMYTGKNIDLNELLFANTYDIDHIIPQSKLKDDSFDNIVLVEKTINKDKDNRDYLDESIRLRMNKFWNFLREKGFITIEKYNRLRRNTYFSDDELSGFISRQLVTTRQSTLEVKKLFEFIFQNTDVVCSKANLVSDFREKYGIIKVRDLNDAHHAQDAYLNIVVGNVFDTKFTKNYWKFIEDRRKVDNIRETYNFKKIFDYDVSRGENVAWLKDYSINTISEMINKKTANITQMITEGKGQLFDLTILKKSKIDKKLTVIPNTPKILKSSLKDSCKIAEKYGYFSTLMPAYFVVFKYIDKNKEVFGFDRIFIFDREKINSNEDIEKYLEDKGYNSPKFIRKVNLKQKILLNGYPYRIVGFTDNKLEIKNSKQFYSDGEHLKYIKHLSAFYNNNNNVKNGEYRINFLKKTSENDRNETTDEAKERLNIEFIKLYEYFCERLNSKIYANYYNSKKYDELIEVFDCFKNLNLLDKAKLLLEFLKIFKKDTYGNFKLLEKPELDKNGKQKLDKNGNLSFEGLSMAFGKLNGKKFKQLVEKDIQFVDESVTGLFEKKEGLEKWQDGEQ

SEQ ID NO: 1083 - protein, 1191 aa, Porphyromonas somerae
MSKHVLGLDLGVGSIGWCLIALDAQGDPAEILGMGSRVVPLNNATDAADFSIGKAFTASQERTARRTMRRGFARYQLRRYRLRRELEKVGMLPDAALIQLPLLELWELRERAATAGECLTLPELGRVLCHINQKRGYRHVKSDAAAIVGDEGEKKKDSNSAYLAGIRANDEKLQDEHKTVGQYFAEQLRQNQSESPTGGISYRIKDQIFSRQRYIDEYDQIMAAQRVYYPDILTDEFIQMLRDEVIFMQRPLKSCKHLVSLCEFEKQEKVMRVQQDDGKGGRQLVERKVKFGPKVAPKSSPLFQLCRIYEAVNNIRLTRPDGSPRDITPEERAKIVAHLQSSASLSFAALKKLLKEKVLIADQLTSKSGLKGNSTRVALAAALQPYPQYLHLLDMELETRMMTVQLTDEETGEVTEREVAVVTDSYARQPLYRLWHILYSIEERDAMRRALITQLGMKAEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGVDEVRVELARELKMSREERERMTRQNGERKKANDKVAEKIQKCGLFPTKSRIRKYRLWEEAGRQCLYCGRSIGEKQCLNGDDMEVEHIIPKSVLYDDSYGNKTCACRRCNKEKGNRTALEYIRAKGWEAEYMERINGLLDKKTISYSKHQRLRWLKEDIPSDFLERQLRLTQYISRQAMAILQQGIRRVSASEGGVTARLRSLWGYDDILHTLNLDRYDSMGETERVSREGETTEKLRIKDWSKRKDHRHHAIDALVVASTRQGYIQRLNRVSSESEREAMSGEIEVQKATKTDKLSLLERWLTQRPHLSVRAVSDKVAEILISYRPGKRVVTRGRNIYRKKTADGREVTCVQRGVLVPRGELMEASLYGKILSQGRERIVKRYSLHALKGEVVDPRLRELITTYNQELKSREKGAPIPPLCLDKDKRQEVRSVRCYVDKPSVSSAIPIRFDERGTAITFVQSGNNHHLAVYRTPQGVLEESIVSFWDAVDRARYGIPLVITHPREVMEQVLQRGDIPESVLKSLPPSDWMFVESLQQDEMVAIGLSDEELQSAIEAQDYRKLSEHLYRVQSLSSKYYVFRYHLETSVKDRKNTSGRIPKFHRVRNLPDYEKRNVRKVRVDLLGRISLL

SEQ ID NO: 1084 - protein, 1487 aa, Prevotella amnii
MKNVLGLDLGSNSVGWALVKTEDNGNPIGSIKMGSRIIPMSQDILGSFEKGDTVSQTAQRTLYRGKRRLTERHVLRRERLCRVLHIMNFLPDHFDKLLGWDKTDNKTYGKFIDDSEPKLAWRQNKNEKEKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKRKSDIPLYDWVGKTLQLIVVTIYEKDGKTPKIFDSGKQNPSYRLPKEDDWGLIKKRTESQIQSSGKTVGAFIYDNILSKPADKIRGNLVRTIERKYYKKELIEILQQQAKYHDELHNQHLLESCAKELYAHNDVRYNEVVKSNMIHLLVDDIIFYQRPLKSKKSLIDNCKYESYEYVDKETGEVKEMPIKCIAKSNPYYQEFRLWQFIHNLRLSDVVTREDVTAQYLSTPQDYCNLFTYLNDRKEIKQDILLKDFFQIKKVQIDKEKVFPIEWNYIKDATKTYPCNETKYELLSALKRAGMDKQWLDDTPNMQYRLWHLLYSVEEKEESAKALRKLYDDDNFVSSFLKIKPFEKCYGAYSEKAIKRLLTLMRMGKAWDEQAIDAKTLKCIQQIITGNIDSKLKEKIDDSRYVLHHVSDFQGLPTYLASYVIYGRHSEVTDIRCWDTPKDLLKFICGFPQHSLRNPIVEQVILETLRVVYDIWKAEKHIDEIHVEVAREMKLTAQQRNEANLRNLNNEATNLRIKYLLEELKNDTFIKDVRPLSPMHQEKMRIYEQAVLGNLNKQDKDYDDIIKISKKERPTSAELIRYKLWLEQKYCSPYTGKAISLSKLFTTAYQIEHVIPQSRYFDNSFNNKVICESEVNKEKDKMLGYEFIKGRGGDRIYCTAHGKEVTILKEEEYKQFVNEHYAHNKRKRDNLLAENIPESFSSRQLNDTRYITKTIMSLLSNVVRQQGEEEATAKNLLPSSGAVTDKLKNDWGLKDVWNTIVTPRFERLNKLSGTNDFGEMKEENGNRYFQTNVPSEYEKGFKKKRIDHRHHAMDALVIACTTRNMVNYISNVNANSPKQREDLRQLLCDKNRIINKPWNTFTQDALKALNDIVVSFKNNVRIINRATNRYQRYDKNGKKMICSQKGNDMWAIRKSMHKETVFGRVNLIRKEALPIAKALDNISAICNAQLRAYVNDLVDKHFNKKQLVAHFKSLDYKWNRQDVSKVEVWISSDDKTPMVAVRKPLDTSFDKKKIASITDTGIQAILLNYLESKGGDALVAFAPEGIQEMNSNIELYNNGKAHKPIKNVRLSETLGAKYQVGERGAKTKKYVVADKGTNLFFAIYEDEEGKRYYYSVPLREAIERQKQKLSPVPEYNEKGVALKFYLSPNDLVYVPTEEERTMGTCHIDKTRIYKMVSSSENRCCFVPSTIAKVIADKVELLSHNKIEKAITGESIKEVCWKLKVDRLGNILNVIK

SEQ ID NO: 1085 - protein, 1222 aa, Prevotella sp. DNF00663
MKKRILGLDSGTNSLGWAVVDRDENNQYSLIKYGDLIFEEGVKIEKGVESSKAAERTSHRALRKLYFRRRLRKIEVLKVLVKYNLCPQVSEEELHLWHTRKLYPQNKDLLQWQRTDEKAGKNPYIYRYRCLHEELDMSVSANRMTVGRAMYHLAQRRGFLSNRLDNEEDENQIGAVKCGISNLTEEIQSSGCKYLGEYFYKLYNEHGNTVRLRTRYTSREFHYKKEFYAICEKQKLDKKLIEELASALYFQRPLKSQRHTVGRCTFEPNKPRCADSHPAYEEFRMLSFINTIKVQGPYDTELRVLNTEERDSITKLFCRKSKPNFDFEDIAKELAGRNNYCYIGDVVDKAYKFNYRMSQGVSGCPTTTYLINVFGQDWQTGIAESYQAIDTKLGQKSVDAMIDDVWNVLYSFSSKDKLRDFGRKKLQLGDKEADTFANIKLTHKFASLSLKAIRKINIFLRMGLVYSHAVTLANIPTIVGTDIWQRKRNFILAELLPLIENFNPKETKLQETLDFCVKDFLQNNFELKNGAVDKLYHPSMIEAYPDAGLNSNGILQLGSPRTNAIRNPMAMRSLHEIRKVINQLLKDKIINQDTEIHVEYARELNDANKRKAISIWQKSQEKLHKKYVEEITNLYKEETGKAIVPTDTDILKFKLWEEQNHICLYTGQQIGIAEFLGATPKYDIEHTIPQSVGGDSTDMNLTLCDSRFNREIKKAQLPTQLGNHADILVRIAGWKNSYEKLSKDIDRIRTHSGMAKDIKDRLIQKRHLLKLERDYWRGKYERFTMNEIPEGFSRRQGVGIGLISKYAGLYLKSLFHDKNERNKGHVFVVKGTTTAEFRKMWGLQNEYEKKSRNNHVHHCIDAITIACIGKHEYAQMAQYYHDEAEYLYHHGIKPIFPKPWKTFTEDLLDLEHSLFVVHHSPNNMAKQARKRIITSTGQHWAQGDSAHGSLHNDTYYGAIERDGEIKYVVRRAVSSFEQMSDVDSIVDDVVKETVRKALEGKNFKEAVNAPIYMNKEKGVLIKKVRCYAKSIKKPIDIRTHRDSSSKEYKRKFHVSNDINYLIAIYEGTVKGKVKRDFEVVKNIEAANFFKRSQDRRDYPTIVPEKSIKHGFPLKTTLTNGTMVILYEENKEEIDFTKKEDICRRLYKLVGMSSMIVSGCEYGVLSLRHHQEARPSKDIKSKNGAFKNGEALRPAITMLHTQFNALVENIDFNIDVTGNIELI

SEQ ID NO: 1086 - protein, 1376 aa, Veillonella sp. DNF00869
MSNFDNHKDSICKHKGLKKGNYYIGLDIGTNSVGWAATNEQYELLKFKSHKMWGSRLFAEAQTAVDTRMKRSARRRLQRRKFRLILLESLFSKEINAVDETFFMRLHESNYHVEDKTNLVKYTLFIDKNYTDVDYYKEFPTIYHLRHHLMTEGTKDIRLLFLAIHHILKYRGNFLYGKKEFSVDGEMYSVLRSTLEELGFGSYVEDENVLQSIANLVLDRGIARSEKVKQIEPLIAQGKKLSSVEKNRLKAWAYLIMGLKANLVNLFTDEDVEVVLPEEKEFKSINLHEGIYEDVRDAYEDAWGDRFAIVDQCKVLHDIIVISSIIKPGQSLSEAKIESYNQHKEDLVLLKSVLKEDKKLYDDMFVVDIDKGTNYVKYIKQGVNGNTSTTQEAFYKYVRKVVSVLPETENTRCIVQKLEEGTFLPLQRISKNGVVPYQLHKEELVRILEKAKLNFPFLNEVEDGLTVADKIISILEFKIPYYVGPLNPTHSIENGGFAWVVRKEAGQVLPWNFEQKVDVQASAVKFIENLTNKCTYLIDQDVLPKYSLLYAEFSLLNELNNIRVNDKPLPADVKQAFIRDHFISLQDSKTATKKVVAKYLVDNNYVSQPPIITGMDQQIATKLTSHRDMTRILGEHFDYAMAEDIIRYITIFGESKDMLRQVLKNYYGDRLTTEQIKKLGKLTYTGWGRLSKKFLSDIWGMKKNDDDAEAGTIIEHMREGQENLMQLLSSSYSFIDVVQEYVTNVLGAKEKTAFEMLEDLSLSPMVKRSVWQTLRILDEIVSIRKELPKKIFVEVARTNKADKKRTQSRKALLEELYEQIKDEDVHVLQQELESKEDSALNSKKLYLYFTQMGRCMYSGRRIDIHELFTDTYDIDHIYPRSLTKDDSWHNIVLVEKQLNAEKTDRFPILSAIQSKQKGFWKLLWDRGFISEKKYDRLVRTTDLTDEELNQFINRQIVSTNQSVKAVTTLLHQLYPETEVVFSKAENISDFRRDYGFVKVRSINHHHHAKDAYLNIVVGNVYHEKFTKNFLSFAKQKGTHRTYNLTKMFEYEIKLTEESKKVIWDPNIHMDIVKKMMKSNDVRVTQRAVPQKGGLSDETIYKKGIAKRGVYLPLKSSDERVRDVEKYGGRTSITISEYIILNIRDTSDQDRIEIFSLPLYIAGKKDIHKAIEEAYLSTCKKPASVVDIQILYRGLYIGSKVNINGFTYYMGGKTGSNVSVDSAVDVVMDITSSVYIKLLEKVAIKKIENSKTFRIENIKTSYNHKEVTVSKEQNIALYQELLKKLDTPLFSKMKGNKLEEFRTVGFDTFIALSLEDQASVLLEVLNVLTNFKTKRDITKIGMTSSRSTLGINISNTEQFSVITTSITGLYEQEIKIK

SEQ ID NO: 1087 - protein, 1333 aa, Eubacterium sp. CAG:251
MGKEYYLGLDIGTDSVGWAVCDTNYKIPKFKGNAMWGIRLFEKSNSAEERRGFRSSRRRTQRKRERLKLLEMLFDEEISKIDPAFFIKLRESNLYLEDKSTKIPYCVFSDENYTDKDFHRDYPTIYHLRNELIKSNKPHDVRLVYLALHHIIKNRGHFLFDYSYKNDKSGDFMPIYNDLKNYFYDNYEIELDCSDVDEFANTLKDKSKGKTKKNAEIAELFGVSKKYDKVLYSALSLLSGSSVKLFDIFDDEALKDVEKKSVSFSSGFDDNANDFQSYLGERFELLEKLKAVYDWAVLADILDGKEYISEAKVAIYEKHKRDLKTLKKYIKIYMPEKKAEIFNISSKDNNYVAYSKHIKTSNGTGVLISTCTQEEFCAYLKKTLGICKDASYEEMFKEIENSTFMPKQVTKDNGVVPMQVNEKELVAILDNAKEYLPFLLNKDNDGKTVYDKIKALFEYRIPYYIGPLNTHSTKSWLVRSNEKIYPWNIEDVVDFDKSAEKFIENLTSKCTYLPQYDVIPKHSLLYNKFCVLNELNNLKIDGEKISVQLKQDIYNDLFKKYYKVTNKKLCDYLKSRNIAFDEISGIDNDFKSSLKSYKDLVAYNLTDEQKEEIVKAITIFGDDKKLLKKRLKNEFGGCLSDDEIKKICKLKYTGWSKLSREFLTDVTAVYKETGELINIICALWETNYNLTSLLYSDEFCCDDKENKTFNDKINELNSFGNDKTLNQIVEELYVSPLVKRPIYQSLLITKELEKIMKCPPKKIFVEVARGAEEKKRTVSRRNKLLDLYKSCKNDYPLLFDELQNNTTDDELKSDKLYLYFTQFGKCMYTGENIELGDLFNKNLYDIDHIYPQSKIKDDSLDNRVLVKKTTNAKKDNEYPLSSQIREKMTPHWKALLDKGLINKKKYERLVRNYPLSDEELSQFISRQLVETRQSTKAVANILEQLYPRPDTEIVYVKAALASEFRHQYDMLKCREVNDLHHAKDAYLNIVVGNAYNGKFTHNKANFIKGLQNNDKAYTVKLDSMLKHNIDGAWIADNNESLNIVKSTMNKNNIRYTRYAFEKKGGLFKVTILKKGNGQASIKKNDKRNSIEKYGGYNQVSSTYFSCVEHGKDNNRMISMFSVNLYDKNKYEENPIAYLIENYGLINPIIKVKKVKIQSCISFDNMLCHLGGKDSGGSQISYRPGVQLVLGYDNERYIRNVIRCAGGDLHLQTSKNEKDIVTAEKNIELFNLLIEKMKNNIYGVLYSNLGDKLYCSKEKFEKLDIVEQCNVIKNVLTILKNNASKGDLKSIGIKANGAIRLNNNISEIKKVKSIKLINQSVTGLFEQEIELLNL

SEQ ID NO: 1088 - protein, 1445 aa, Chryseobacterium indologenes
MMIKNILGLDLGTNSIGWALIKQDFENKYGEILGMGSRIIPMGAELSKFEQGQAQTKNANRRVARGTRKLNKRYKQRRNKLIYILQELGMLPDQIKLVNQFSDPNKLDKISILPISKNRQQLTAFDLLELRVKALTEKIELEELGKIIYKYNQLRGYSGGNSEPEKDENNEDESEEKEKTNDSFVVFSKVLSLGLPEEITFKGKKLNKRKISIETEDGIIEAETFLDNIKENDSLELQVNIRRAKSGDTITIKLPSKTSWRKKMENIEKQLADKSKELDREYFISELLFDILKENKWAKIRNNVILRSRYESEFDAVWSQQSKYYPFLNHLETDRLQKILEFIFPGQKESQEKLRQTGLKEGLKYVIKNQVVFYQRELKDQSDLISNCRFEPIEKVVAKSHPVFQEYKIWEQINKLVINTKIENGVNRKGEIRYKYIDKPIPVALKEWLYEELESKKEVSFNPILTKLKKEFNLRENVDFLNGMNAKDKLKGNETKVILQKALGELWNIFSLDDSERQVELWEILYNGKGNEYDLTSERTSNVLAFIEKYSPDLENKNDVAIKISKIKFSRNYSNLSLKAIENILPLARAGKFFDQNFSEALSQKILKLLNENVEDPFEKSAQEFLDKNQDVLSDGGIVNAIATILVYDKHTAKEYSGDELLKEFTQISRLKQGELRNPLAEQIINEALIIVRDIWRKYGFKPDEIRVELARELKNNAVERGKMYSANLKSQKHNAEIRNKLIELKQEISIANIEKYKLWVSQENLQEVYLKNYNDPSKSEIEKLKLWESQGHVSPYTGQPIPLSELFNRERYDVDHIIPQSRYFDDSLSNKVICEKSINNEKGNRTSMEYFEVGSVNYRIFTKDQFIDHANKYFSGKKRINLLATSIPEDPIQRQIKDTQYISIRIREELNKIVGNENVKTTTGGITDYLRNHWGLTDKFKVLLKERYEAVLPKIAQLEYDNYKKETEKKFTEYKNADVEFNEPILDEEIFIEKFRSEFIRKKNNKLIIKGWSKRIDHRHHAMDALVIACTQPAHIKRLNDLNQVLKEWLDKNKEKFFPGFSGTKTELLDEVLNLEEEKRREIFNQLEKFRAIEMPWNGFPEEAEQKFKEIIVSHKPKDKLLLQYDIQGNKQIKLRGQLHEAKNYGLKNGKETKRIQLSELFDKEKSATLGNLNKITNEFLKKIILKHYEEDYKFNNKDAFSAEGILDLNKKLAERKDEQGNPKPHPPISTIKIYYKDPSKSKKKKTDDEDDISLQKLDRQKSFNDSLYVKTGDNYLFAVMEKEVFDKKLKENKMERHYDLITFFDAANLLKSEFNNSEDKKNFSKEDLFRKYFEERNNARLLFTLKQGDFVYLPDDNEEIILDESSPLFMDYWKNTSERSNSIYVVQKFSKKQIYFLKHTIADTIVKKVEFGSQDCYEKVGVKSIKDFCFKINSDRLGNISKV

SEQ ID NO: 1089 - protein, 1504 aa, Croceitalea dokdonensis
MKRILGLDLGTNSIGWALIENDFNRKEGKIEALGSRIIPMSQDILGKFDSGVTVSQTAARTNYRGIRRLYQRDNLRRERLHRVLNILGFLPKHYAESIDFEDRLGQFKPETEVKLPYRKDSDDNYHFIFQESFNEMVEEFQFKNPSLFYTKANGEQSKIPYDWTLYYLRKKALSKKISKEELAWILLNFNQKRGYYQLRGEEEADSKDKLEEYHALKVSDVQATEDTNAKGTWYNVILENGWIYRRQSKDSLFDWKGKTREFIVTTSLEKGGAVKIDKEGNEKRSFRAVDSEKDWIAIKKKTENDLANAGTTVGVYIYETLLRNPDQKIRGKLIKTIERKYYLEELKAILAKQIQEHAELQNRSLYKDCIEELYQGNEAHKNNIKENGFDYLFLEDIIFYQRPLKSKKSTISNCPYESRVFIKDGKKEIQPIKCISKSNPIYQEFRLWQFIHNLKIYEKEAIDDGKTVINKDVTTEFLNTQEAYAALFEFLNDKAEISQNALLKYFKLSTNTHRWNNVEDKKYPCNETRSEFIKRLSKMDGIDLGKTLSPAFEKSLWHIIYSVKDKKQYVRALETFAMKNGLDINQFRENFEKFKPYDSAYGAYSEKALKKVLPLIRRGTYWKKDAIPAAVQERIVNIMKRIESVDFNLEKIENFADDDIPKQLLKSFAKGKDPMQGLNTYQACYAVYNRHSEVSDIQLWKSPEDITKYLDSFKQHSLRNPIVEQVVMETLRVVRDIWQYYGNGAKDFFSEIHVELGREMKNDKKTRERISKSITENENTNERIKNILKELMGDEALQGDIRPYSKGHQDILKLYEEGVFANAPETYKNIKIDDIEKIRKNNSPSKSDIVKYKLWLEQGYISPYTGSPIPLSRLFTTDYQIEHIIPRSRYFDDSMGNKIICESAVNEEKTNKTAYEFIKENAGRIIDLGQGKQVPLFDLEAYESHCRGYFKGNTKKLKFLLSEDIPEGFINRQLNDSRYISKVVTSLLSNVVREEGEQEATSKNLVPLVGTITSKLKKDWGLEAIWDDLIAPRFERMNQLTKSTDFRKEVIDGHGNRYFINTVPDDIKKGFSKKRIDHRHHALDALVIACTTKDHVNYITSLNTQRNNRSLVSKLRKIEEKTIKDKRTGQPKTIKIAKAYHKPWPNFTKETFEKLSKTVVSFKQNQRIINKTNNKTWGWEKVDGVMKKVLKKQEKRNWAIRKPIHKETYYGKVKGFDSPKGKITTATRKSLREITNERQLNTITDSGIKKILNNHLKTFIDESGKINFEPAFNQDGIDLLNKNIQQLNEGKNHQPIYKVRMYTHNTMFSVGDEGNKSTKYVIPESGTNLFFNVYWDEENNKRNFETVPLNRVIAFQKQTSHIPRKDRTDVPIDNTLGRFLFTLSPDDLVYLPTDEESESFTTFEIDSLNSKQVANIYKFVDGSGTTGNFVPAEAARVIANIKDKKVRSNFCKRNNLSDKQLIKNEFGLGSPQLKNQNSLDGRQIKSICWKLEINRLGKIIKVIK

SEQ ID NO: 1090 - protein, 1319 aa, Fructobacillus sp. EFB-N1
MGYNIGLDIGTGSVGWAALTDEGKLARAKGKNLIGVRLFDSAQSAAQRRSYRTTRRRLSRRKWRLRLLENIFSDEMGMIDENFFARLKYSYVHPKDEVNNAHYYGGYLFPTQQETHDFHEKFQTIYHLRLKLMIEDCKFDLREIYLAMHHIVKYRGHFLNSQSKMTIGDSYNPRDFQQAIQNYAEAKGLIWSLNDAQEMTDVLVGQAGFGLSKKAKAERLLSAFSFDTKEDKKAIQAILAGIVGNTTDFTKIFNRERSGDELKKWKLKLDSEAFDEQSQAIVDELDDDEMELFNAIRQAFDGFTLMDLLGDQTSISAAMVKRYQQHHDDLKMVKEIAKKQGLSHQDFSKIYTAFLKDDTDKGMKALLDKADLADDVLVEIQQRIESHDFLPKQRTKANSVIPYQLHLAELEKIIENQGKYYPFLLDTFTNKAGETINKLVELVKFRVPYYVGPMVTAADVEKAGGDATNHWVKRNEGYEKSPVTPWNFDQVFNRDQAAQDFIDRLTGTDTYLIGEPTLLKNSLKYQLFTVLNELNNVKINGHKIDEKTKHVLIQDLFKSKKTVSEKAIKDYYLSQGMGEIQIVGLADKTKFNSNLSSYIDLSKTFDAEFMENPANQELLENIIQIQTVFEDVKIAERELQKLALPDEQVQQLAKTHYTGWGNLSDKLLSTPIIQEGSQKVSILNKLQTTSKNFMSIITDNKFGVQQWIQEQNTAETADSIQDRIDELTTAPANKRGIKQAFNVLFDIQKAMGEEPNRVYLEFAKETQNSVRTNSRYNRLKDLYKSKTLSDDVKALKEELESQKSSLQSERIGDRLYLYFLQQGKDMYTGQPINIDKLSTDYDIDHIIPQAYTKDDSIDNRVLVSRPENARKSDSATYTTEVQQSAGGLWKSLKNAGFISQKKYDRLTKGGDYSKGQKTGFIARQLVETRQIIKNVASLIESEFSQTKAVAIRSEITADMRRLVAIKKHREINSFHHAFDALLITAAGQYMQARYPDRDGANVYNEFDYYTNTYLKELRQSSSSSQVRRLKPFGFVVGTMAKGNENWSEDDTQYLRHVMNFKNILTTRRNDKDNGALNKETIYAVDPKAKLIGTNKKRQDVSLYGGYIYPYSAYMTLVRANGKNLLVKVTISAAEKIKSGQIELSEYVQQRPEVKKFEKILINKLAIGQLVNNDGNLIYLTSYEFYHNAKQLWLPTEEADLISQLNKDSSDEDLIKGFDILTSPAILKRFPFYELDLKKLVNIRDKFIAVENKFDILMVILKALQLDAAQQKPVKMIDKKSADWKDYRQRGGIKLSDTSEIIYQSTTGIFEKRVKISNLL

SEQ ID NO: 1091 - protein, 1163 aa, Chlorobi bacterium NICIL-2
  misc_feature (1158)..(1158): Xaa can be any naturally occurring amino acid
MERSLGLDIGANSIGWAVIEQNGTGGAILGVGVYTFPEGVENFGEGDREISRNATRRAARQRRRQLFRRKLRKRALLKLMATHGLCPALSEDELRQWHKSGQFPERTEVQQWIKLNPYHLRLRATQERVTLYELGRIFYHLAQRRGFPTSSRRAQQDERSTIEKGDVKAGKPGIEQTRALLDHAPTLGSALATLYPPEGQPYRNNTSRIRNRYTDRQMYVAEFEFLWEKQRQFYPYILTDDLKAQLGGRRKDGYSIDGVLFLQRPLRSQKHLLGRCTFEPSKPRCLRSHPLFERFRALQFINSILCNDLPLDADDRSRVLRLMLTKKNLKFTDIRKAIGKLSAEYIFNYADDDSIVGSPTNAALASKNIFGKAWFDKSDHEQHQIWHVLQSFDDRDKLIHHATTKLGMSDTAAKHFASVQLTDGYASLSLKAIRAILPFLEQGYPYHLAVALAGTRRALGPRWDQLDEEQRTALCDTIEGLVGSGVRGGYLDKLKEMLRTKFKLSDKELSKLYHHSQFRAANQLLNRIPTDAVYTSQLLALRNPAVTNVLFASRRLVNELLSRFGHFDRIVIELARDLKRTKSQRAQIRKEQQRREIINRTISAILEKEGIRPTAENILKYRLWLECNKTCPYSNRSISFHQLYNGEVQVEHIFPYDRSLDDSYLNKTLCFADINRKKGNRTPYEFFTNDFGMDRWEEVKQRLRQTFTNQRSWQKDSPLDYFPERRKKYERFIAEKLPSDFVGRQLNDTRHASIRAVEMLQLVCPIVSASAGTATAKLRNLWGLDRVLGDLESDTKSRNDHRHHALDAIVLACTRPAHIQQLATANARKYSKEPQLEPPWSSFRFDVEDAMQRCIVVHHRTNRVITRLNVTTTVGGTVLRYRSLAARGPLHRETFYGKHLDPSDGQVYYHVRKPLAQITKRAQVEKIVDRAIRELVEARIKELGSYGSNDDVPKGAFFGTNPDGSPQPLLFLPNRRGEPVPILNVRLRESLANARPVHPNQNRYVDPSNNHHAIIYRLPDGTLEISVVQFWDAVLRCRLRQPLYQVPPNCELVMTLHINDIVLLGCPDKVLEEVFQTLTPDQRCKSLWPYLHKVQKLSQSSPKSWELCFRHIADARPSEEAKKDYILIRNWGTGKQGWFTYNPIKLRVTPSGLIYRWXELPHH

SEQ ID NO: 1092 - protein, 971 aa, Unknown
  NCBI_LFLA01000003:307495348918_23
MFHIYGYFCYNDIFNYLVKLFWGKPVDRINYRLGIDLGTNSLGWCLLKLNEKSIPEKILLAGARIFSDGRDPKSGSSLAEARRLNRGARRRRDRFLGRKGALMQKLVELGLMPKNKYERKKLEVLNPYELRAKAIENSLAPHELGRALYHLNQRRGFLSNRKTTTKEEGQKIKPDIDGLKEALDASPARTLGEYLWLRDKNKQRVRARIDEKLYPTRALYRDEFTQIRSCQLRHQKLTGDEWQALETIIFHQRDLKTPEPGRCQLEPNEYRARAALPSFQKFRIAQDITNLAWIDEKGGKHFLTAEQRKKLWNLLHKQKTVKFGKVRTTLELPEGVQFNLEDEKRKDLKGNVTAKLLSDKKYFGEKWFDFSDKIRDQIVEELLDIEDEKAVIQKAMNTWSVSEEQARNLASLLPEDFPKGYCRFGIAVLQKLVCCMRDDGLRYDEAVKKLGYHHSNNRPDELVEKLDYYGKMLPKAVAFGDPDEASPEKKFGKIGNPTVHVALNQLQKVVNDIVTTHGHPQEIVVELARNLKLSKKRKDDLEKEQRKNQKNNERIEGELKILCLENNGPNRLKYKLWEELSSDPNDRLCPFSGEKITPVNLFSPQIEIEHILPLSKTLDDSQNNKTLATREANHLKHDRGPFKAFGAGDTGYDYGDILDRAHQLPKRKFMRFLPEAMERFDDENQFLARHLNDTRYLSTVATEYLSHICRTVRVIPGVLTAMLRHKLGLNDILGERGIKDRNDHRHHAIDALVTALTDQGLLQRVSQLTGAGLLEPSEELSDPVKPRLKAPEVWAGFHKEAEEKINHIVVSHKPDHGIQGPLHEDTAYGIIQHPSSWEKENGYNVVRRKPSSDLSRNEIGAIRDPDLREKFMNFANTFENDKELKLALPDFAKNLGVLRVRVLKKEHPIIEIIHQSTATKPQSQKRNHKKGLAPGPVHHLEFWQNPDGALHQGVGRVSGSIFSRPIKMIRS

SEQ ID NO: 1093 - protein, 1557 aa, Unknown
  NCBI_LFLB01000022:248971291537_11
MKIISPIAIDMGAKNTGVYLNHFEQGEDPTTSGNIAGKTIVIDSSKITWSQAGRTQKRHQVRGNKRRKLAKRLIKVILKSHYELDIEEKQLEFLMGLLNRRGYNRIELTPEQEEVLSTKAVTEFFFPRLFTEPSTGVSLLDGLSDRVIIKNKDNQDYWKSVLKDDVFSLSGKQNKEFKDYLALHDKGKDKDEIADLSKAFTAIKQVIGKQIENYDSGHLHRRDYLENIKKDVQNELLKSLLSGDLTAEKLSFLIGNVSNLQLRVLRKYFNDYGMQSGDKWAPDKLHEFFFKWVRSWHCKQDDERTNQRTLLARKGKDILEVFTTSNPELSIPPYEDQNNRRPPKDMTLRLKPKGLDNKLSNWESITRSLVKSYCMPQTEKNIIEPVCIQKNLKDNVRPQKIKGEVQDTEQRQILADTLHRILDRTIKLDPYKLRWLSEGSKTDEAQKAKEVLNRHSENKADAIIDFAKEYYDEVDIAKQGLWSDSEQSLFFRCNTNPPHKNKIQHNLISHILGENLNEQRLSYFVDDCWNEKIGRLTIKGIAKKTEEERKKYGNRFKHLVQRQVWLNKQGDRELDNERKHGVNGKVILEVHEKCLKATDKIAEYFTHNDRKKKIYANVFSMAQLYNILETNIRGFSKTDNWNTIENAWRSRKDDADEQGEYIANAVRLTADSIRPFDGMLDRIISRQAYEIAGMKIQQIGNLKIDTNDTLFVPIFMEQNRFSFEQSLHEIKGLKNVKKKAKERVEKGLKKQKTQWQNKDDRIKKNKYCPYTGGIIGKGEIDHIIPQSESKKRGDVVFNSEANLIYCSGTGNHTKGNVRWTFEQLHPNYLNEVFAGETNIKQTIIDFVNGLDENDPISFHNLEGKEQNYLRHALFISDLDSKTFPILNTRYKTFVNGTQGYLGKKIRKLLQDKYPNVEIKTYQIPAQEVSQLRKVLGSLDKTSKKQDIQSAFSHVVDASLVLATALQNPKIAEELQSTNVTELSEQGQWLKALLPTHADVQHIERKPKYRKNLSSTQIFKEGLYGERFMPILLDNEKLYYGFSLDNCHEIEPLKQPKNHSKDFDKKVLTVKEKQLVAHNKYFDLLKEFLYTGSSRRKNKKPVTDSMQDNQDKYSYLSIDTIKALNHLQKCAKEVCDTRATEQAKKLEKLRYSVEKKNIKNVLLQGRGRRTFIKQLDDKKFKVSKLTLPAKKDWERLINHPIIDYQGNKVTLKECFDKPEQVEIDNPKMVNFWQDLSQESGFKIEYLKDNLLKKNDKGEFYKQLGIIPKGVFDQKIKTMKLLKPLANSALLEQSFGVEFKTMTDLIPQESWDKLFEEFFHTNKIKNNNFHKQVRKDYSLPEVSAPSGGFRIQRKNSLTNETIYQVSAIADGGYACGFAKKKDGSIDMSKNGVTFNPALKASRRTAYIGKSGKPYIHKESDSTEVESFGSSREVALSSESVLKCRLTLAEASRIDVAITISNDIFKKIIEFSSEDIDVSQPPPDFSIKFTKSNGGREEHDKFKEFLNAMNIPTPREAGNPQRWAYKFEVQASQDTVVLSYRTSMTAELKTAYLNGTLVND

SEQ ID NO: 1094 - protein, 1134 aa, Unknown
  NCBI_LFLB01000039:70141795_4
MKNCKNFSFDVGMTSLGVAVNENGEIIHGDVLLMHLDAGSVKAQAGRRRMFRTREAHKAREAVLESLWRSIGKEPLQRKRFTKITGPSGKTTFQKTKADKRLEREFPAKGDSTVYASSLLRIMLLEGEPLEDWQIYKALHAGIQRRGYDQNVPWKTREEAREKEQGRKPGSEKKKKEENPENQIDQFNQDLQEMAPDARYHLPCYYDAWKMGLWDAQTKKIIHIRQQSNSTHKARKYNASRASVTNETKKLLSQAAEQIPELNEHLTEDKLDQLLYGGQQNALDKRYPSATKIDGLLGQKYPRFENRIVSECALIPRLNVCKSEKSLAIEVGFLLRLVDWRYETEDEHGSKSEHSLTGQQIINKFQECDSAWKKKSQAYKPEEYAKCFKLTPSKVAKMAEKLGGSVKTGHEDIPASRHAGRSRFSQPALHLMKSLILSEKTPKGFYEELSQIVATQEKENPGAEFGYQIFPDIPYKYFLDDFRFLEKMGNSRDTIHVPDMSLAERYLNEYGDVESAIQKVINSCNWPELRHRLNVFRRELENLIKKYGTPDAVHLEFIREDFLSPKRKNEYSKRAKTGNEDRQKAIKTLKELKIPITEKNILRYRLYTEQNKRCLYTDDSIDISALESYDIDHIFPKEDGGPDAYYNKVLTSADVNRKQKGKRLPCECDFINWAAFKTRLKNLHLGNNKKKLLLASPRKEAEELVEKYTGLSGTAYIARLARDIVCLRFGWQPGAEGEQQRIFVISGGLTSKVAKKYKLYQALGDGSKHYQKDRSDHRHHALDAMVISYLRQWARDKNKTDFFKFPAGVNADYFAKKLACVNPHYVTKMRPALAEQPKPNRSAGKNKMNKKEYKNLSKDPEERGQWYTNKSETGKGTSQHGYLFYKDDKGKVCHKTIHSFRSPYEVKKEVEKKASKIIGLFYQGKSIDLPSQDQITATQLGRDARLKFGEYMIIKILKKEVIIGDPKQPQEQSKDTNSTGRYRIPFADLEKIKVCNELKREKPFDLDGFSVDKDKTLTGTYRVDNGQPSLRNFIIIDTKTSEEKLVNFASLVKYLAEKNWLNDLEVKDIVTINKNHISYINKVKADNLPNQNLPDGRYQIKRFESGGNEVCLVSQNGTVYRMNSKVLEYAKRTD

SEQ ID NO: 1095 - protein, 1669 aa, Chryseobacterium sp. FH2
MAKNILGLDLGTNSIGWALIEIDHENKIVKIKGLGSRILTMDAAEIAKFESGAKIESGAAKRTTLRSPRKLNERYLLRRDRLHCVLNLLNSLPQHYKLSIEFENEKGKRSGKFKKGAEEKLAYYKDDNRKFQFLFKDAYYQMENDFKKKYPEMFYQRKNGNETKIPYDWTLYYLRHKAVTDKDFELTKEQLAWITLSFNQKRGYEKVIGQDEKMQKEGELTDNFVGKVQSITKIENEEAYLIVLVDNNNEAIELFKYKEETKIPITEIGDLKEVEIVSKYDDEGTIDSKKTEYIINEVREFLITDVRNTGRKIKENFIFEVELETGWIKEQQSKFTPKWKDTNRDFIIKTKYDENGIRIPKGADKGRNINIPKEEDWTLMKLKTETSLTSFNTKNNTKGVASFVYYNLLQNPKQKIKADLITVIERDYYREELDVIYKNQEKFHPELKNRDLYEQAIQLLYPNNPNHQKTIKELDFNHLIKEDILLYQRDLKSKKSLIANCIYEKENFERTDEKTGKKYKNPLKAIHKANPLYQEFRLWQFIKRLKIIKKEEVINEEIKINLDITSQLLTNELKEELYAFLNERESVTEKDILGFLNKKYKDLDINTENYKWNFASEKEPCNPTRYNFILRTKRIKGFDYRTFLTPENEYSLWHFFYSVKKKDEFTKGLTNIISRLLDKSGLSKEFHEDLVKNFSSFGGYTNDYGTYSEKAIKKMLPFLRLGKYWNSKDIENILSKTNHEVKQKVLDKEEINGEIKDFQGLWVSSACYLVYGRYSEVGEVQFWQSPYDIENYLKNEFKQHSLNNPTVEKILVETLHVVKDIWKYYGEEIGKDEEEKIIYNKLFDRIHIELGREMKKNNKQKERDDKQNKENRKANERIVELLRELKQNNSSLQEKSPFQQEKLRILEESLLSSIEYDKDNTEYQLSNGKITKKEIKEITTKELSKVSRSDFERYKLWLDQRYQSPYSGRFIKLSDLFDRKKYEIEHIFPQERITLNALYNKVICETEINKEKKASTGYGFISNAKSKKVFCSAHDSEIEIIGIKDYEDLVNNNFSGRKREILLSKEIPEEFTNSQLNNSQYISKMAMKLLSNIVREKGEDTFRSKNVLATNGTITTTLKRHWQLNDAWNEIISPRFKRLNKLTNTNLFGDYREINGHKVFINTVPEETNKNFDSKRIDHRHHALDALIIALTTENHVNYLNNISSQESSEEKLNTRKGIKFQLTNSRRGFNDEKEWYFLPPAQIKTKDGIDEFEYQFKDIKSKVFKDIAQNALENTIASFKQKNRVIRQRWNKYLKSEDGKLNIIKQDGLKEVVNYNVRKRLHEDTFYGKVKLQDKITTIGLEKALIEKYDLVDDELIKEIEGLKNIDGKSLKEIIGLLKSKHPKVSVYEKFVATRFGNNLETFASVPSDKIIKAIHSITDTGIQKILENHLNNYKEVVDGKTKFDVENAFSSDGVKELNKNIVELNNGKVHCPIYKVRTSDAMGTKFSVSEEGQKSTKFVVTAAGSNSFCGFYQKNTERKFYIPTLRESVESLKQGFEPCPATHPEDSEFKLIFVLNPSDLVYVPTDEEKENPKLIDFNNLKKEQFSRIYKFTDGSGTTMNFVPANIASLLFNMSNKEQEKTEIKLSIQNELGLGSPQSKNQNTVDGIQVKSVCLKLKVNRLGNISKA

SEQ ID NO: 1096 - protein, 1031 aa, Aquabacterium parvum
MAKMRYRLALDLGSTSLGFALLRLDEASNPCAIIKAGVRIFSNGRDPDGNSLAVTRRMARAMRRRRDRLLRRKARMMHLLIEHGFFPKDPEARKALETINPYELRARGLDESLTPEEFARALFHLNQRRGFQSNRKTDKKDNDNSALKSAIKRLRDALAEGQGRTVGELLFRRMQTGQTVRARYRESKALKPDGKTKIDKSYDLYIDRAMAIDEFEALWSKQASLNPDIFCAAAYHELKECLTKQRPLLPVRPGRCTFMPEEERAPLALPSTQRYRMYLEANHLRILREGLHEEVLTLTQRDALVQALEHNPKRTFVQIKALLGLKGAVQFNFEDPKRQELKGNITNAILSKPGHFGQSWFTFDEAKQDDIVSRILSEEDESALIKWLLLETGVNEAQAEAIANVGLPEGYGSLSRKALARIVPALRQEVISYDKAVQAAGFEHHSQLDASAIGEQHPTLPYYGEALQRHVSFGTLDANDPDEKRFGKIANPTVHIGLNQVRTVVNDLIKRYGHPSQVVVEVARDLKQSRQQREETNKRQADNQKRNARIRQEVAEASNGSISPERVKVADIQKWILWEELNENDVLNRCCPYSGARISALDLLSSDGRVEIEHILPYARTLDNSLNNKTVSMRWANRIKGNKTPAEAFGQNQVESCNYEAILKRAEQMPKGKRYRFAMDAMERWDKEGNGFLARALNDTRYLSRITREYISLICPHATRVIPGQMTALLRHQFGLNGILGLRGEKNRNDHRHHAVDACVIGVTDQKTLQELSNASKRGRDQHIMDWAESMPDPWPTYREQVKRAINHILVSHKPDHSHEGAMHNDTAYSLLGNGRVGVHKLVDGKRTLVEDTLKVIEFDYAKAKHSTNEPWFDSDHNHRSGAYKGYKGDSNYCIEIVSNDKGKWEGEVISTFDAYQLVRKERNAGRDGVSRLRHPTLSLSGKPLVMRLIRDDYVKLETDEGMKLMRLAKLAADGRMFWVEHNEANESARARDKEDAFTYTVKTPVGLQKAKGRRVTVSPIGELRDPGFKG

SEQ ID NO: 1097 - protein, 1012 aa, Limnohabitans planktonicus
MANMRYRLALDLGSTSLGWAMVRLDAQNETCAVIKAGVRIFSDGRNPKDGSSLAVSRREARAMRRRRDRLLKRKTRMMATLMKHGFFPQDEAARQALVNKEPFALRAKGLDHALLPEEFARALFHINQRRGFKSNRKTDKKETDSSALKKAIGQLREAMQASGCRTVGEWLCARHQQGLSVRARYRENRITKDDGKTKIEKSYDLYIDRAMIEAEFDALWAKQSELNPELFHETARAELKDCLLHQRPLKPVKPGRCTLLPDEERAPLALPSQQRFRIYQEVNNLRLLREGLNEEPLTLTQRDQLIQALETNPKRSFTQIQKLLGFSGQFNLQDDKRTELKGNSTSAMLSKKEFFGSQWLSFDETHQDEIVMQLVSEENEARLIAWLQAETGVDEITAERIANTPLAEGYGSLSAKALEKILPALRADVITYDKAVLAAGFDHHSHISHAATGEILPDLPYYGQYLQRHVGFGTGKPEDPAEKRYGKIANPTVHIGLNQVRTVVNALIKRYGHPSEVVVELARDLKQSQEQRKEEQAQQAKNQRRNERMRQDIAGLLNTSTERVRALDLQKMILWEELSFNVADRRCPYSGVQISAQMLFSDQVEIEHILPFSQTLDDSLNNKTVAMRQANRIKGNRTPAEAAADFAAQGWPVEDMLHRASLMPKGKRYRFAQDGMAQWLREDKGFLARALNDTRHLSRVAREYLSLVCPQGTRVIPGRMTAMLRAKFGLNDILGLNGEKNRNDHRHHAVDACVIAVTDQSMLQKFAKASASAREKQLNKLVESMPLPWDSYRDHVQRAVERIWVSHKPDHGHEGAMHNDTAYGLLGGGHVQVRKRMDGVRTRETAALKVIEFADRQAHPRHGLLPNGEPMPYKGYKGDSNYCMEIVRNDKGKWEGEVVSTFEAYQLVRQHGLARLRHPALSVSGRPLVMRLLRNDTLRVIHNGEQRTVRICKMTAEGVIALADTTESNVDARTRTKDLSYIFKTAGSLQKSKGRRVAISPSGEMKDPGFFD

SEQ ID NO: 1098 - protein, 1044 aa, candidate division TA06 bacterium 32_111
MKYTLGLDLGYNSIGWAILENDENGSPIKLFNAGVHIFEPSIEDIEIDGKGKTKNVKRREARLRRRQLFRKTKRLEKLLNFFIQEGFFQNQKVLINDPFERAEFLYQLDKKSRNPYILRREALDNRLSLEEIARIFYHIAQHRGFKSTKRELAEMNKDEKKKKEDGIIQSEINTLKEEIKKNSCRTLGEYFAKLFENGEKIRGRHTDRKMYEEEFQKIFNKQKEFYPNIFTDEFKKKLYKLIFHQRELKSQKDKVGFCSLERGKKRAPLALLVSQRYRYMCKVNNLNVIDTETGENRELTVDEKKKLYEKLENSEKLSFKEIKKILNLSEKRYIFNLEKSEKYIIGNKTNVKMKNIIKDWDNFDEDKKNFFINEARTVVKIETLERRGKKLGLSDEESKEFSKVVFEDGYLNFSKKAVEKLLPYLKEGKKEYEAIKLAYPENSVQNDNLKELDFLPPIKSKELKKYFEVRNPIVEKALTETRYLVNFLIKKYGKPETIKIELARELKLSNKQKERKHKENQENRKKREEVIEKLKNDLKISEPTETQIQKYLLAEECDCKCPYTGRSISMDSLFGEHPLFDIEHIIPFDRSLDNSFLNKTLCYSEENRKVKHNKTPYEAYYGTEKWEAIIERVKKFKSNVRNEKLRRFQMTKEDVENYIQNFSTQNLNDTKYASKLAKKYLGLLYGSINEDGIDKNRKRRIFASSGKVTSTLRYALGLNTILNDENIKTREDHRHHAIDAITIALTDSSMIKKISDASKREKNINSLFKDFQAPWENFRKEVEEIIAKMNISIRINKKVSGQIHDETFYKKPFKEEEKSYTHQRINLEELTIKDEDKKKQSSKLIDNIVDSKIRNIIINSLNGEKPKIRFKDPKDHPYIIQKNGKKIQIHKVTIKTKLETYNEIGPEKAKRYVKSSDSHHIEIFEDLKTKKWDGYVVSLLEAYERKKKKLPIVNKNLGEGKKFLFSLAKGEIIELDTENGKRELFVVRIISASNNQIKFTRINDSRKITDIPATGLTACPSSLKKRNCKKVVINILGEKHYSND

SEQ ID NO: 1099 - protein, 1427 aa, Lactobacillus delbrueckii
MNKKLDKEYTVGLDIGVANNGFVAIDDDFNIIKHGHRHEIGVTEFKKAKTAESTRISRGSRRRYRHQKWRLKQLKDYFMPHFIDLMGEEETEEYFKGFKDSWVSNDDDLRKGRRKNFNSEIKEFPTRYHAALALINNDSQVPTDPKKRLKLIYEVIHPMVKYRGNFLRKEKVDDLDLGELDIDSSLTRINLLLKNIKTSDESATYTINTENSTEIRGILLSKEYTRSNRKQKLTKCLETTDSDKAVVEVIATFLVGDEVKRVKIEKVFGVDASSILNSKGNPVSSFSLNPKKDGNLDNISKLTELLSSSGKEILDELKTIYNQVTLHDLIPLGKSYSEAMVESYDKFHKQLVLLKAVMKRLDSEDKIKLEEKLDDYLNFKHRGSKKSSAADFQKAVIDTLEPKSKDKDKKKQKEKYQDDPDIQKLVFLADNELLLLPQRNYKNGTIPHQVHQLELRRIIATQSQIPGFEWLADNDLISPKRDEKYNLERFIDFRIPYFVGPLTTNEHSRFAWLVYNENVKRETLTVWNFEKQIDYDKTIENFITRMTATDTYLLGEPVLPAKSLTYQKYEVLNELNNTRISKRPLSVEEKQAIFNDLFMKQKAVTTEQVANVLRCRFNRSVKTSDITGPSNGVDYNSSLSTYLTLKKIKGIDDSLLTSKKYASDWDKLTKYLTIFEKNDVVRKEARIKKLKLAQVENFPVKEIASLSLDGWGRLSSLLLNGIYIGNRSRKESIMDLLWRTKSNFQQIITKEECQKQISNYNQKYNDLPSKNQKINSVLKLSRISPENERSIRVCINIIEDLVRFNGREPKLIALEFARGSHKVNNAPKYSRIKKLIEEQITTSEWKDTLQNEFKRFKTPKDFGIKEYLYFSQNCKDIYDPSHTINLDELDRYEIDHIYPRSINGKDDSLDNLVLTQSKNNQKKGNLPAVKVFSNKAVSSYWTKLKDNGFISEDKYNNLNRDWIDNATNQFKIRMLKRSFVQSSSIIKVTAQILTMLYPNTKIVAINASLSHRLRSTFNLFKVRNVNDFHHAVDAYLAAFEAQFLWKLYPKLRPLIDYNDYQKLDSAALKDVDLQKFAFLALTDENHHLVHGDMIVNSDGEIVGRKSKLIKRLTNLRNPDNIRIVKMPTKAEGGLFNSTINHHSKNPKKAVPRKKNMSPEVYGFYSGTVTSKIVLIKTVKQTKDGKSNQYSLDKLTNLSKSDEENAISKLVDAKLNSKTTLDKVITLPINTLFERKVPVTWEDGEGHQHQKLTTERILLSSDEEYHNFNGFTLSDNAMSFLQTFNSNESDKVIAKKLIEMQNEYRGYKDANDALNQIFDEILLKCKLELPLISQGHKPFESLSSAKAIKAFHDYSSDLSKKLQDIESILLAVSDTSRLELSSLNSVKGLKGTLGRFNRGIKSHLMDDTVLVFRSATGLFERKIAFKDL

SEQ ID NO: 1100 - protein, 1410 aa, Chryseobacterium sp. Hurlbut01
MTKNILGLDLGVSSIGWALVQENSKNPENNKIVKLGVRVNPLTVDEQINFEKGKPITTNASRTLARSARRNLQRFKLRRANLIDVLKKGNILKQGDLLTEIGKNSTFQTQELRAKSAKEKVELSDFVRILLLINKKRGYKSSRKAKNEDEGQIIDGMAVAKKLYEENITPGEYSYKLLQEGRKQLPDFYRSDLQAEFDKIWNFQKQFNPEIFTNELYKRLQGKNRNATWKELEIPFYLVGIKQIGTMQEKKIERYFWRSEAVKKQLDFESLAVVFQEINSNLNNSSGYLGAISDRSKELYFNNQTVGEYLYNQLKINPHTKLKNQVFYRQDYLDEFEKIWETQAKYHKKLTKELKEEIRDIVIFYQRKLKSQKGLISFCEFENREIEITVNGKTKKKTVGLKVVPRSSPLFQEFKIWQRLNDLEFKNVETKEIFPLELEHKEILFGNLNIKGNLSSKELIEQLGYPSKEWKCNFKEIDGNKTHENLYTAFLKIIANEGIEFPKEFKLSIDDDIKVSKIDVSSEKIKEFIKENFLKLGINTSILDFNPELDGKDFEKQESYQLWHLLYSYEGDDSASGNEKLYELLEKKFGFKREYSKILADVGFSQDYGSLSSKAMRKIFTYIKENKYSEACHLAGYNHSKNSLTKEQLANRILKEQLEILPKNALRNPVVEKILNQMINLVNEVIKEYGKPDEIRIELARELKKNAEERANMTSDISKATLLHQKYAEVLQKEFGIKAPSRNDIIRYKLYLELANNGYKDLYTNQKIEKENIFTDKYDIDHIIPQSRFFDDSFSNKVLVPRCANQDKDNYTAVDYIEKKYGERGKEDFLNRIHLVFKSKEAIAGKSESQISSMNTKFLKLQKKGSEIGEGFIERDLRDTQYIAKKAKEILFGITNSVISTSGRITDKLREDWNLVNTMKELNLEKYRKLGLTELIANSKGEEKERIIDWTKRNDHRHHAMDALTVAFTTHNHIQYLNYLNARKDEKHKEHHNIFAIENIITEIVEKKNGSKERRFKLPIKNFRTEAKKQLEEVLISHKAKNKVVTKNINKTKKKGGVVSKIVLTPRGQLHKETIYGSAKFLKTKEEKISGKFDLETINKVQNEKFKNALLDRLKEFNGDSKKAFTGKNVPAKNPIYLNEQKTEQVPESVVLAWYETGYTIRKAVNADNFKDYKNLEKIIDKGVKEILKNRLNAFNGNAKEAFSDLEKKPIWLNQSKGIAVKTVTITGINNAETLHYKKDHFGNELLDENGKKIPVDFVSTGNNHHVAIYEDADGNLQERVVSFYEAVERVNQGLSIIDKEYNQDLGWKFLFTMKQNEMFLFPSEDFNPKETDLFDEKNLNLISKNMFRVQKFGSLLSGFWFRHHLETTVDLNSSLKDTSYKVIQSCNNLKLIVKVRLNHLGKIVQIGEY

SEQ ID NO: 1101 - protein, 1512 aa, Chitinophagaceae bacterium PMP191F
MAKILGLDLGTNSIGWSIRETDSNSRMEYYQVYFRELLEKIKETQSILDNEIIDYGVVVFQKGVGEGKSGEFSLAAERRKNRSKRRLYNAKRYRKWELLKVLIENWMCPLTMEELRLWSIGNWQEVGGRKKNTGRIYPLGNEAFQKWLAFDPEYFGEKEISENGKVIRKNPYDLRFELISSEETNDFAKKQKVGRALYHLAQRRGFKSSRKSGKSTYAENAELEKLKQRNPDFQITMLAKEKLENGKRFRASGVIQRRYFEDEFYAICQKQNISDELTAKFYKAIYFVRPLRSQKGLVGNCTFEKGKARIPVSHPKFEEFRALQFINNIKWREVGTQTYEAIPISLKKNIFEELFFRKLTSGKNKGKTITETYFKFDEIVEKYSENEKYEFNYKNKPNISTCPTIAVLMNVFDAEWENKFIADENSYGINWEGLSISYTVKYGIKEGENRKLEVDEIWHLLFDYIQTKDNAEELEVFCKNVFGFDPDKARAFAEIDIQQGYGSLSYKAISKILPFLQSGFVYPEAVLFANLKKVLGDTFEVNKVQAKRIIDDAIKETSAIKEKRNIVNGLIQQFFAEHNTNRAKGIDNTIKEMAAQDTLNKLKKYFGESDWNKKTETEQRLWEDEILNLYLKFLEGKQIKEEKASVQLGKNPEIDYYKLPRVDESIKQCLKASFNLPDDRLRHLYHPSDIEMYPRSKSEIEVRINGVEQFVKQLESPQPPSRGWKNPMVMRTLHELRHLLNCLLRIGKIDYETKVVVEMARELNTKNYRKAYTDWINDRDNENKSFKASILEVYQITEPSIDDYNKFRSAVEQIVNTELIENKTTIFQNKYQEFIDTYLNTIKIPENNKDELMSNEYYDYLMYLILNRGEFRKMLNFKIPNSNKWQTQLIATSSSFEKKWKELSEMLTKYRLWKQQKFQCIYTGQQISFTQLFTENYQIEHTIPRSISFDSELKNLTVCDSAYNNFVKGNLFPTECPNYETAKVCKTVKGDITCFPIKDRVEESIFPKVKELHTRIKNLDTINKGLNDEEKKNANIRLRYYLKFELEYWERKLLTFTIKKGDWKDSWKNSQLVDTQIISKYAKAYLKSIFEKVDVQKGSIVNDFKKIYQIKGDGQKDRSWHSHHAVDAATLTLIPGSASREAILKEYYIALENKKKYHAKPYKGFQTSHLLDIEKIIVVNHISHDKTITESFRNIRKRGFKTGWVAQGDSIRGRLHEETYLGAIKPNEVKDEGKAIKDPISGKYLTKQLNGKDVIWVVQRKKIEDVDIDVIVDEALKAHIKWQLGNGVKINEVKDFAGNTIRHIRFKKFSPSYDKAIQVKPHLFSSKYGHKNFYLANNEINYLCLLYIGKDKNGKEIRAFRFVNLFEFSKMKDKRINLLFHNEDYNVFVKVNRSNEYKLNIKCILKVDQKVILYKSSIEEIDKQNLDNYRCRIFKIYKFNNSGSDYIFLQNIIEARNDDGLIKAGFTKDGDTEFKPKQYQPRLKLTADNFNCLFEGVDFEIKPDGTIKWIKS

SEQ ID NO: 1102 - protein, 1066 aa, Clostridium botulinum
MVNEINYSLGLDIGTTSVGWSVINLDLNRIEDLGVRIFNAAENPKDGSSLALPRREARGRRRLLRRKAYRIKRVKKLILDRKILSQNELNNLFVNKDVISVWNARIKGLNEKLSGEEWAKILINLCKRRGFKSNRKNEMKDKEAGKVLSSIKSNFEKMKETNARTIGEFIYNEVMTSKDNYKALRNKSEQYNMCVSRDMIREEIHTLFEKQRAFGNEFAKDEIEDEYLNIFNSQRPYSKFEDLEKMVGFCTFEKKKYKRAPKNCISAEEFVLYEGLNKLSIVNSGNKRKLTNNEREIIIKEAFKRKEVKYTHLRKILNLKEEDRFLTLTYSIDKDISKTENTKFVSLKGYHEIRKSIEHGVSKEYWQQIKDNKKMLNDIAYVLTLGKTDEDIVKQLKLRNILDEKVIESLLDISFSKFNNLSIEAIEKILPFMKEGYQYNDACEKAGYDFKAIYKGVKLKKLPVIDIDEIVNPVVNRALAQGRKVINAVIDKYGSPTRINIELARNIAKNFKDRKAIEREQKENRDNKEKIREEIKNLMGKEPTGSEVLKYRLWEQQRWECAYTQQPISIDQLFTSGYCEIDHIIPFSRSFDDSLSNKVLVLGVENQRKRNRTPYEYFGEDTERWNKFEIWVKGSHLNYKKKMNLLKKKFSPEEQREWKARSLQDTKYICRYISNYINNRLEFRESESKQKVITINGRATAYLRAKWGLIKVREDGDKHHALDATVVAVATQGMVQKISKYSKAHELKSVRSCDGVVDVETGGVVETEEFRNTLKEILPRPWRGFSEELVLRLSDDPIAQLKKSPIKSYDQEFIKNTVKPIFVSRVPFRKIKGRLFGETVYSKKAFKDGYFISKKKLIDLKKDDLDKFYNYNCDKKLYDAIVERMKKFNYNAKKAFEEEFRKPTKSGDKGPIVRSVKVKVKIPFKDGVEFNEGLVAKDGMARIDVYEKEGKYFSVPVYKYQLAIGIIPKKAALAKKTEEEWTIMDENYKFKFSLYRNDLIEIKYKNKNDYLGYFEGFDINSAVITIKNHDGSKRYRGIGIKSGVKEFNKYEVDVLGNYYKVKAGDR

SEQ ID NO: 1103 - protein, 1404 aa, Chryseobacterium sp. ERMR1:04
MAKKILGLDLGVSSIGWAIVEEDAENVMNNKIVKLGVRVNPLTVDEQINFEKGKPITTNAGRTLVRGARRNLQRFKLRRLHLIDILQKRNILKQADLLAESGRNSTFQTQEIRAKSAKQKVELSELARVLLLINKKRGYKSSRKAKNEDEGQIVDGMSVAKKLYEENTTPGEYSYELLKSGKKQLSDFYRSDLQAEFDRVWNFQKQFYPEIFSDNLYKELQGKNKNATWKILEIPFSLVGIKQVGTTQEKKIEKYFWRSEAVKKQLDFESLAVVFQEINSNLNNSSGYLGAISDRSKELYFNNQTVGEYLHCQLKENPHTKLKNQVFYRQDYLDEFEKIWEIQSKYHTVLTKELKEEIRDVIIFYQRKLKSQKGLISICEFENREIEITENGKIKKKEVGLKVAPKSSLLFQEFKIWQVLNNLQFQNIESKEIFPLDLDCKESIFNEVNIKGRISAKAVLDVLGYSGKEWKTNFKDIEGNNSNENLYNAYLKIIANEGIEFPKEFKCNLDDDINVSKIICSAGKIIEFVREKFSELGINTSILDFNSELEGTNFEKQKSYQLWHLLYSYDGDDSPSGNQKLYELLEKKFGFKKEHSIILADIGFPQEYGSLSTKAMRKIIPHLKTGLPFAKKSDNDTILSATAMAGYNHSKSLTTEELTKRVLKEHLEILPKNSLRNPVVEKILNQMINVVNEVIKEYGKPDEIRIELARELKKNAEERANMTSEIGKATIQHQKYSEILQKEFGIKSPSRNDIIRYKLYLELSNNGFKDLYTDIQIKREELFTDKYDIDHIIPQSRFFDDSFSNKVLVPRGANLKKGNLTAFDYLESEGKDTLEKFINTITEFYDKGIITKAKYEKLQKKGTEIGDGFIERDLRDTQYIAKKAKEILFGITNSVVSTSGRITDKLREDWNLVNTMKEMNLEKYRKRGLTETVINSKGEEKEKIIDWSKRNDHRHHAMDALTVAFTTHNHIQYLNYLNARKNEDHKQHKVISNIENLITKVFEKKNGSKQRRFLEPIHNFRIDAKKHLEEILISHKAKNKVVTKNINKIKKKGSIIAKIELTPRGQLHKETIYGSSKYLKTKDEKLSGKFDLETINKVQNERYKNALLERLKVFGYDSKKAFTGKNILAKNPIFLNIEKTEQLPEVLTLAWYETIYTIRKSINSDNFKDYKNIDKVTDKKVHNILTDRLREFNGNSKEAFSDLEKNPIWLNKPKGIAIKTVTITGVNNVEALHYKKDHFGKEFLDEKGHKIPVDFVSTGNNHHVAIYEDTAGNLQERVLSFYEAVERVNQGLSVIDKEYNSSLGWKFLFTMKQNEMFLFHSEDFNPQEIDLYDEKNLRLISKNLFRVQKFTVKDYFFRHHLETNVEDNSKLKGDTWKREGLNGIRGILKVRLNHLGKIVQVGEY

SEQ ID NO: 1104 - protein, 1371 aa, Unknown
  NCBI_LIUG01000107:2583861111_13
MKCITKAAEMRKTVDIIVIFVRRILGWNERDRKICDYICYFTILSYMKKILGLDLGTSSIGWALVNEAENDEESSSIVLLGVRIINYDNFVSTKTGKESKEPEKDFAGGKGISPNAGRTLKRSMRRNLQRYKLRRENLIEILKEYKFISNESILSENGNRTTFETYRLRAKAAKEEISLEQFARVLLMINKKRGYKSSRKAKNTEEGTLIDGIEIAEELYDRNLTPGEYCLELLRKNTKALLPDFYRSDLQTEFNRIWEKQKEFYPDILIVQLKENLQGKNEKQTWAICREPFGIVGAKRNGDKGEQEKENYEWRAKALNEKIDLEYLAIVLQKINSQINGSSGYLGKISDRSKELYFNKQTVGQYLMAILDKNSNTSLRNMIFYRQDYLDEFETLWSKQAEFHIELTETLKKEIRDVVIFYQRKLKSQKNLISFCEFENRKIEVEIDGKKKIKIIGNRVIPRSSPLFQEFKIWQILNNIEVTDKNSGEITLLSKEEKEKLFAELQKAESLSTKKALEILFEKRAKNYSIENYKEKIEGNKTRAKICEILNKTLADEKLNELWHLLYSWESENSNLAEKLEKKYVYPSDIAKKLSNITFLDDYGNLSARAIKKILPHLKNGKQYNEACELAGYAFSKSSLTKEQIENKILKNRLEILPKNSLRNPVVEKILNQMVNVINSIIDIYGKPDEIRIELARELKKGAKEREEMAASIAYATKENERIKKLLQSAPFNIANTSKNDIIRYKLYEELASNSYRTLYSNTYIPQESLFTKDFDIEHIIPQSRLFDDSFSNKTLEKRQENIEKGNSTAYDWMAKKGEKELADYEIKIKNLFDQEKISRAKYNNLKRREKDIPDDFIDRDIRDTQYIAKKAREMLQELVRVVVPTTGSVTAHLREDWQLVNVMQELNFPKYERLGLVEEIENKDGQKIKRIKEWTKRNDHRHHAMDALTVAFTKYAHIQFFNHINSHYDSTSEIYGIKQKYFTNDNKALPPIPLKNFRVEAKKQLEKILVSIKAKNKVVTTNINKVNNQKTLTPRGQLHNETIYGSQKQNVVKEEAINAKFNEAKILTVTKLAYREALLKRLRENENDPKKAFTGKNSLAKNPIYLDNMHTKQMPEKVKTVTFEIVYTIRKPIDKDLNVEKVVDVKVREILKDRLNKYNNDPKEAFVNIKENPIWLNEKKRISIKYVTIFGVSNVEALHDKHDKDGNKQPVGFVSTSNNHHVAIYRDEDGNLQENVVSFYDTVKRANAGLPVIDKEYKQSEGWQFLFTMKQNEYFVFSNEKTGFDPKKVDLMNPENYHLISPNLFRVQKIASKNYMFRHHLETKVSFETKEMEKQLRGIAWELYQSTEKLKYIVKIRVNHIGQIIQVGEY

SEQ ID NO: 1105 - protein, 1327 aa, Flavobacterium akiainvivens
MSKNEVCRIYEIFFCSILTYFLKKYNHDIFKKSSTMKTILGLDLGVTSIGWAVIVTDDDNTPIKILGMGSRIIPLSTADKEEFQKGQAISKNQSRTIARTQRKGYNRKQLRKEELKKILGELGITPSKELLNLPSIELWKLRADAASGNAPLSAEQLGRIFYMLNQKRGYKSARSEANQDKKDTDYVAAVKGRHQQLKEKGQTIGQHFYTEMLTLEENSGHFQVKNNVYPREAYLEEFNAIIAAQKPQHAFLTDDVVDRLRDEVIFYQRKLKSQKGLVSICEFEGFERTFFDNVKQKDKTIFTGPKVAPKSSPLFQLCKIWETVNNINLKVKNTDGSKNKWADYVPTLEQKQEIIEHLFKNAGISLDALRKILGFNKDEIFVNKQIEKGLQGNTTYAEIHKILGDSKPELLGFNINIEPSKHSALLVDKRTGEILAEKEGQQVSAEIEKENFYQLWHTIYSIKDLDECAAALIKRFNIDPNVAAQLAKIDFSKGAFGNKSNKAMRKILPYLMQGYNYADACSLAGYNHSDSQTKKEKEENVVDDKLKLLEKNSLRQPVVEKIINQMIHVVNAIIDKYGKPDEIRVELARDLKKSKDERNEAELQNASNKKLNEEVANRLKELGLPVTKRFVQKYKFIFPVRDRKIKEAQLVNQCIYCGETFNVTEALSGDNFDVDHIIPKSMLFDDSQTNKVLVHRKCNAKDKSNKTAYDFIAAKGENELAIYLDRVDDWFKRGVLSYGKMQRLKVSYEQYAERKQLKKETEADIKLWENFIERDLRQTQYIAKKSKDLLKKICNNVTVTEGKITAQLRNLWGWDDVLMNLQLPKYKALGQTEIKEWTSEHGRRLHKKEEITNWTKRDDHRHHAIDALVVACTKQGFIQRINTLNSSDTKDAMDREIKAAKEKYNELYDKKLLTETNEQVKNHTERFNKLETYLKSQQPPLFTTRYVEQEADKIFVSFKAGKKAATYGIRKIKKDGKKVVVQEKIVVPRGALHEQSVYGKIKTQEKDKPLKYLFENPETIVDNRIKILVKERLDKFEGDVKKALTSLKKEPLFIDNEKNTLLEKAACYTDATVLKYKLQALKANQVNDIVDEGVKRIVKARLAQHKNEKEAFKDTVWFNQEKRIPIVSVRVFARPDASKLAIIKTDENNKPIGFALTGNNHHIAIYKDNTGKLVQHICTFWSAVERKKFGVPTVVKNTGTLWSELLHKDLPGTFLDKLPQDGLELEYSLQQNEMFVLGLPKESFEDAIKNNDLPLLSKHLYLVWSISDNDYWFRHHLETKNSELKSTTGAKESKRYYRFQSVGTFTKENPIKVQLNHLGEITKIGEP

SEQ ID NO: 1106 - protein, 1030 aa, alpha proteobacterium AAP81b
MATELVFGIDIGTTSIGSTVLTLDRDAGHGELHHLGVRIFPEARDEKHLPLNHTRRQKRLARRQLRRRRVRRRTLNELLATQGLLPAFGAQRDSAWRAAMAIDPWPLYAAAETRALTAVELGRLLYHVAQRRHFQGRALQGDGGAGPGDSETAEERQAQSQRERDRAALRAAGTNIGAFLSAIPDGERRRGRHFAREDVRAQFVTIIAAQRLRHPVLADPVILGALTEAIFSQRPVFWRRGTLGRCRLVPGAMPAATASWLAQEKRMLEKLNDLIVEVGNGRPLDTAERHAVIALLRRQDSVTWGALRKALRLPPSNRFNLERGGEKGLTGNRLENRMAAIVGARWDSDAALRDSLRADLHRRLFAADYAEIGERIVIRDTASAARERAALADNLARDFALPVAAATALADIQQAGGWTPFSEAALAAMLPRLAAGARFGALLNGPEEEGWRDRTFPARERPTGALVRTLPSPADRDEQARLGAIRNPTVVRVQNELRKVVNNLIRAYGAPHRIRVEVGRDVGRSAREREEITTRTRKREAERRRAAADLVAQGIAVQSGRDIEKWLLWQECRRTCPFTGRAIGFEALFRTGEFQVEHIWPRERSLDDSFANKTLCHVDANRRKGNRTPAEAFDAADLAAMVERVRSFAGPPGLIAAKARRFIQPIPDDFASRQLNDTRHAALQVVTQLKMLFPDVGPTAEVRVQVVTGQVTARLRRHWGLADLLGDGDSKTRDDHRHHAVDALVVAAAHPGYGAALSRYFAARDSGVLEPQLPLPFPDIRAQAQAKLATLVVSHRVRRKLSGPLHKETVYGDAGPARGSGGKEYRYFVTRKPVAALTPSLLKDDEAWPDAHIRDTLRHWLAAHDGDIKKALTSGLPTVSTGGPEIRRVRVRVKQQAKLMATLKNGHADLGNNHHVAIYRDATGVHTEVVSLFEAAQRQARHEPVVRRQRPDGATFVMALSPGEIIHFAAGTRQGLWVVKGVWAAGPIILWRAADARGVSVWRPVAATILGDGGVKVQVDPIGRTRPAHD

SEQ ID NO: 1107 - protein, 1188 aa, Chryseobacterium indologenes
MKYILGLDIGVSSVGIAVISEENQKKTIENLAVRIVPEDPDFHGKFYSGNTASKNLERTAKRGNRKNNQRFKARRDKLYQSLKENNMFPTSNLFDLSAVELYGLRAKAVSEQVSLQELGRILILLNQRRGFLSNRKSVSEENSTEYKERIAGLEKALGNKTIGQKLYSELQENNNVFEVLLRERTYQRSSYTEEFDRIWDEQKKYYLILTGSSNEDDNKGTLYDLIRNRIIYYQRPLKSQKGLISECLFEKHHKAVAKSSPYFELFRIWQKINDLSWKTPNGELFKPTDEQKQKLKNALWNGDNLNPKHKLTVSKIKEILGYTSREKIYLNFTELDGSRTYSILRNALIEAGIEKPEQYLFFNMETNDEKGGLFELWHITYSLPIEKEVINALKNRFGFDKKQAEIIARRVGYSSDYGSLSTRAIRKLLVHLEKGLGYTDACDNIGYDHSGYKTKIDLQPKLKQLKRNELRNPVVEQILNQVVNAVNLIIEKYGKIDEIRVELARELRNNAKTRKNISLLNSKNKKNNDIIRKKLQEEYGFKFVNGRDVTRYILWEENSKECLYCNKTINGSDMLTGNADIEHILPKSRSFNNAMNNYIITHRKCNSDKGQKTAYDFMSSKGEVILQQYIEKVNDLYKDGKGSISKTKFENLLCKGEDIPSDFVERMKKDSQYIAKEAVKMLKTVCPNVYTTTGQVTDFLREEWKLKNLLQELTFEKYKAIGQVKEKIIKTNNGQTKTFKVIADWSKRDDHRHHAIDALICALTDQKIIFKLNNLNKIYQYERNALSQKEIEEIEEFLEGKFSIKEFSAQQGNIIECSIPNIRKDAQKHLENILISFKKENSKVLTMNRNQPKNCKEQITWVPRARLHEDTIMGRVKRIPEKKMKLNDKVSFEQIKMIVNPEIKEILLYRLAKFGDNPKVAFATKALKKEPIFYRENELKEVSIYEWVNTKRVALNENITDSQIEKIIDQASKRAVKERLNGGKIKEVFKNLTENPIQLKNGMILKNVTVTDESKVEKIRNGFAITGKNHHALVYKDENGKYNDKVVSFWEAVAIGLRNVTEYGNPYPIINRNHNDELGEFYFSMQINDLFVFDLKHSENPQEENEINFFDVENRKQISDKLFRVQKMSKKSNGQFVSDFRHHLETSVIRNDMILKNITWISISKNSDLERLTKIRVNHLGEIIKVGE

SEQ ID NO: 1108 - protein, 1084 aa, Rhodobacteraceae bacterium HLUCCA08
MRLGLDIGTNSIGWWLYGTEGGRITEVVDGGVRIFSDGRDPQSKASLAVDRRAARSQRRRRDRYLRRKAALMKRMAQVGLMPADPAEAKVLEVLNPYELRASGLDGPLPLTHFGRALFHLNQRRGFKSNRKTDRGDNESGKIKDATARLDQAMMAKGARTYGEFLHMRRAAALDPKSVPSVRTRLTVARRDDAEKEEAGYDFYPDRKHLSEEFDKLWAAQARHAPDVLTEDLRDEIATIIFHQRPLKTPEVGLCLFTGQHGVPERDKRIPSAHPLNQRRILMETVNNLKVAAQGEPSRPLTREERDQIVHALDNKKHTKSLSGMTMKLKALGKVIKLRPEQGFTLETANRDAIACDPVRASLSHPDRFGARWSTLESAGQWDVVQRIRAVQSDAEHADLVGWLMDVHGLDRDHAEETANAPLPEGYGRLGLTATTRILAALEADVLNYSAAVAACGWHHSDGRTGEVLESLPYYGEILERHVIPGTGDPNDDDVKRYGRITNPTVHIGLNQLRRLVNRIITVYGRPDEIVVELARDLKLSEDQKKDVQRDIKKNTEAAIRRGKKLEEMGVPNTGANRMVLRLWEDLGDDVMTRNCPYTGKRISAGMLFDGSCDVDHILPYSRTLDDSFANRTLCLKEANRQKTDKTPWEAWGETEQWEAIAANLKNLPANKAWRFAPDAMERFEGEKDFSARALADTQYLSRIARAYLDALYDGDDGKSHVWVVPGRLTEMLRRHWGLNGVAALTDSDKQTVKAKNRTDHRHHAIDAAVVAATDRGLIKRIADMAKRDEFNGAEEVARSIPPPWEGFRDDVSAQVTRIIVSHRADHGRIDPAARKSGRDSTSGQLHNDTAYGIGRDGTVVSRKPLASLSPNDIVVTKRGANIRDVDLQKHLARVTHGLDGKAFEAALLAFAASPILPDNTDNPYFGLRRVRLEETLQESARVEVADQEGRPYKAYKGDSNHCYEIWCLPDGKIKPQVVTTYEAHQSGAEKKPHPAAKRLMRIFKRDMVMLERDGETIIGYVQKMKQNGSIFVAPHTEANADARDRDPKDDFKLIQLGAGSLVKAKARRVIVDEMGRLRDPGPPL

SEQ ID NO: 1109 - protein, 1079 aa, Rhodobacteraceae bacterium HLUCCA12
MHRFAFDLGTNSIGWAVYRLAADMLPASLERTGVRIFPNGRDPQSKESNAAGRRTPRGARRRQDRSLGRRKRLLDDLIKFGLLPSDAESRKEVFAANPHEARAKAARDQVELYELGRALWHISKHRGFKSNRRAENDGDEKSKIAIASAALLKRLRSEGHPTYGDFLHARLARGEGTRIRPTGEGAKLSYAFYPTRDLLEGEFDHIWVTQAAFHPSLTEDMRRRLHDTIFFQRPLRPVRPGKCTFFPDEDRLPRWHPAAQEFLILSQLNHLRIVDDHGEQPLDITARDLVAHTLMAGTKLTWSGLKKTLKLPSLAEFNLEKGGVKELARNDVAARLLGDTKKPGPLATLWPTLDSPTREEILWQISEVADPDELICWLMERLGLSREVAERIERIPLPDGHLRFCKMATQAIVEELRLDVIPYDEAVRRAPLLGGAGLDHSDFQAEEGVDTLPPYNRLPVLQRMIGNGSGDPNDPDLLRYGRITNPTVHIALGQFRRVMNALIAEYGKPAQVVIEATRDMAKSAEELKKIENTIRDNERRNDRWRAELQDAGLLAEGARIGDRFLRMRLWEEMGRGPADRLCPYTGRPIALHQVHSDEIEIDHILPFEETFDDSPANKTLCFREANRRKGKLSPAEAAVRQPDFFDLPAIIARTKHLPANKSWRFLPGAIQKWQETRGFEDRQLNATGYFAHVARAYAEALFPKTDDEGKRRSHVWVLPGRMTAMLRHRWGLNLGDHNRKSRDDHRHHAIDAAVAGVIDRRMVQVLQTHARNMGVERLDRVLPAPPEPFDGFRDAVLSAVEKVNVSHRAQHGSIDPRDPSQTSGRLHKDFAYGEVRDVPENQTDLTIGNVVRRKPVIGLEKDDLDKVRDVKLRESLRAATEGVKDDKAKLTAALFEWSQKTGHRTLRIIKPASTARPVYGRPGKPRAGEPYKWFIPDENVWIDILQSPNGKWFGFGIDVWAANSGTGQTWQELHPDAKFIMRLHKNDTIQLFDWDDNEKCIVPGSNRIKVVNSIPNSPTNKNVKLVGLNDAGKFAGRHNDKDDPFRWDWPPYDRLRLRRARRVRIDELGRVHTIPHGTV

SEQ ID NO: 1110 - protein, 1195 aa, Actinomyces odontolyticus
MKRLNLNKGRHVSGSECSLLCSRPGLSVRGSVSFETDTNVCALCHYVCMSDYSANVQHRRYRIGIDVGLKSIGFCAIEVDERGTPIKLLNSTVHLHDGGVEPGDGKDLSRKKVSGIARRTRRRRRSNEKRLADLDSYLSQQLGWQLPNLEEFDDPHEPWHVRAELLDSYVSDPAERAEMLAIAVRHIARHRGWRNSYTSVASLTRATYPSKALIKVNERVCEALGTKIVAEATQGQLASAYVADERYALQALRGTQGLFRGRQYQSDTYHELSRILELQHIDRAQIKELTEIVFRVTHPRNGARRNMRVGHDQLPGQESKWRAEIAHPAFQKFRIVAALANLRVRSGGQERKLNANELRRVTRYVLDSALKVEDVEWFDIAEQLGIERDCLTGTAKPVFEGEPALRRPPTDAVSVIVMSSKLTKLKRWWKSANDEDRADLVKFMANSTLAEGEEFENDEVDGFLASLTDDDLAKLEELALPSGRAAYSLDSLQRLTDRMLADGCDLHEARKREFGVSSSWVPKPDPIGAPVGNPAVDRVMKEVSRWLKVAVDRWGVPEAVNIEHTRSGMMSAESAKKLTSANKARRRQIEVLAERLGGQACAGGKLNQVTKIRLLALQRQKSKCLYCGAGIRFETAEMDHIVPRSGLGSTNDRNNLVAVCRECNASKGSQLFSEWAQSGSRKDKVSFDDVIERVWSWGQDPGVSPKQHKKFQAVVVARLKSKKPDQEFDARSMESVAWMAVELGKRIRGYFASASSANEGAVVPSVGLYRGRITAAARVVSGFEGCVRFTGGNGKTRLDRRHHAMDALVIALLDDRIAQLLALRDNLRFAQLVTSGADEWRRYLHSHPSENALMYDWSQHMQVAAKKFNDSLESGMVRFTMNQRLRLGSSRAHMDSVTSFEHAYLDRNGDRVPKLDKNGMRKVKEHGEFRLLSDPLPVDLIDRAETPALWAALVKDEQFDPQTGLPADPKRTITIHGRRIGPMERIRFFGATPAGKWSASLAVRGGYVSISNTIHHVRIYKIAEEPAKYAMLRVYQVDLRHAHGKDLFSFSIPASSISMRTADKVVRKFLRDSTKKPYAWLVAGDELRVNPKFYDEGKIGEFFKEEGYGDVVEWRIVGFESATQVNLRPLRISEEGFNDETPQAVKDIAGRSKSWRVTIGALLEAGGVAVIRRNVLGEERWKSKDDRLPCSKVFE

SEQ ID NO: 1111 - protein, 1352 aa, Flavobacterium sp. TAB 87
MKKILGLDLGTTSIGWAFINEGENDNETSSIINAGVRIVPLTTDEEADFKKGNTISINADRTLKRGARRGLQRFKQRRDALLQSFRGINFISSNYVYAETGKQTTFSSYKLRAKSATELVTKEELVQVLLMLNKKRGYKSSRKAKTAEEGDAIDGMKIAKEIFENNLTPGQWVYNSLSIGGKFIPDFYRSDLQKEVEKIVRFQNQFHPEQMNEKLLENIQGKARTVTSQYFSRILNIPLAENKGTREETKLQHYKWRNEALTEELDLKVLAFIITEINNQINQSNGYLGAISDRSKELYFNQETVGQFQYNQLKENAHTKLKNQVFYRQDYLDEFEKIWETQSKFYPELNDELKSEVRDITIFYQRKLKSQKHLVSFCEFEKGHKAIPKSSPLFQEFRIWQNINNIVVKNETTKEPFLLGEDLKKVIAQELSFKESMTDSQLLTFCDLKKGTHTVNFKKIEGNRTNTSLFKAFEKILVLEGYDELDLSKLDASDIKSIIKSAFSDLEISTAILDFDPTIQGNDYDKQSYYQLWHLLYSSEEDDFLKKSLMDKFGFKESHLPFLLNINLQADYGSLSAKAIKKVLPHLMDGHIYDKACTLVGYNHSSSLTTDQNNERVLKDTLELLKKNSLRNPVVEKILNQMINVINAIIKDPAMGKPDEIRVELARELKNNNEQRSEMTKAINKSTTEHEQIRKLLHTEFGIHRVTRNDIIRYKLWKECDGISLYTGKPIEPSKLFTKDYDIEHIIPKSRLFDDSFSNKTICERQLNIDKSNKTAYSFFQEKLSAEEFDQFEKRVKSLFGKISRTKQNKLLMANNEIPEGFIDRQLRETQYIAKKAKEILLEVSRNVTATIGSVTDKLRDDWELVDVMKELNWEKYDKLGLTYIEEGKNGERLYKIKDWTKRNDHRHHAMDAITVAFTKPAYIQYLNNLNARTNTDKKGNSIIGIENKYLKRDKNNKLRFIEPIPNFREVAKKQLESILISYKAKNKVVTKNKNVTKKSNGTNQKIQLTPRGQLHKETVYGKLQQYVTKEEKINANFTPEYVTKVAKKEYREALLKRLIENENDPKKAFTGKNALSKNPIYISLENNILVPEKVKIVWLKSDYTIRKDITPDLKIDKVIDIGLKTILQNRLNEFNGDTKKAFVNLDENPIWQNKEKGIAIKRVTISGVSNAQALHTKKDHLGNEILDENGQPLPVDFVSTGNNHHVAIYRDEKGNLQEEVVSFFEAVTRNNLGLSIINKNHEKGWEFLFSMKQNEFFIFPTDGFNPHEIDLLNTENYHLISRNMFRVQKIATKNYMFNHHLETKSVDGEMLKTKKQLSKISYHFIQTPSYLNYIIKIRINHLGQIVQLGEY

SEQ ID NO: 1112 - protein, 1367 aa, Eggerthellaceae bacterium AT8
MQLRHAENYNIGLDLGTGSVGWAVTDENGELYHFKKQPTWGSRLFPSANTAAEARVHRGQRRRYDRRRQRLDLLQDFFLEPMASVDPEFFIRLRQSQLWPQDRDPQHAAYHWPLFNDEDFNECDYYKKFPTIYHLRVWLMETDEQADVRLVYLALHNIVKTRGNFLHQDNERLSAKNANMKESVDRLCSALAEWMGEVDPESSCEPKPEKLRAVLEDVSLSRGEMRDKGLPFLGLETDAAHKRIAKQVIGAVLGYKADLKKVFFLETDDPTFDLSNDAAVEEFRSSVPDEGAELFDSLLAAHSSFILQGILKGGDGRTISYCKVNEYEQYGKDLRELKDLVRQYAPTRYDEFFRGPHYEGACSKDYDPSKAKGYTLYNLGTTKLSYDDFASQVKKLFKGTGAESDERYIKMMGRFDEQTFLRRLKTSDNGSIPFQLHLEEMKAIIANQGRYYPFLKKHEKEIESLVTFRIPYYVGPLTQKNAAVAHGEPRFAWSVRNPGKENTPIRPWNWEEVIDKHASAAAFIQRMTGTCTYLQGEPVLPRASLLYEKFCVLNELNGARWSQDGDDWHRFSYDLRARIFDELFTRGTVTYKKIEHWLRSENIALNAHVKGGQGETGFESKLGSYLFFKKVLGIDDFDAQTIEMIENLVLWNTLFEDRDILKEGIQRHYGDVLSPSQIRQICKKRFTGWGRLSKKFLTGITVPTDNGAKSIMDVLEEGDPNNNHPGAAMVLMEALHDDNLGFEKAIAEANKAWMESHGKLGIDEIPGSPALRRSVNQALKIVDEIVSIAGCAPANIYIETTRDDDVDKRGKRTKKRYDAIKEALKKLGAEADADLKKDLASRSYAELDTERLALYFMQNGKSLYSGAPLDIRKLSSYQVDHIIPQSYTKDDSFENKALVLAEENQRKTDSLLLSDAIRRKMAPTWRALHDAGLMGEKKFNNLMRSHISNMQMKGFINRQIVETSQVVKFVRTMLQERYPETNVRSIKASLSHQLRVRRGLVKSRIANDFHHAHDAYLAEEMGRFIELRHSIVFDNPVALQHVIRKYIQEQAERYAKTKRLPEDASFIVQSFLTSGFSKETGEIFRDTWDADAEVARIKKFMNYRQCFISRMPIEETGTFWDATIYSPKGGRTKPTIPLKGGLDPARYGGYSSLKNAYFFVYRAEGSKGRVLRYAGVPVSVASRIKRGDLVLSEYAEQLARNEGLAFEAIVRRKILQDQLIEIDGERFYIRGNKEVRNAIEPCFSLAEAEAIEADDPTGYEAVLDEAFGTLLRFLHRYATRQEGLLRIEERARAFYSLNEEGKQQIICEILNLVNAQKNVANLKLINGPSFAGKIQLTLSKELSSNSTTALIDQSVTGMFERRQEIGL

SEQ ID NO: 1113 - protein, 1353 aa, bacterium BRH_c32
MSKILGLDLGTNSIGCTLRDTSQRENQIVFSTVLTFDKGVGEEKGVEVPLVQQRTMSRSKRRNYNARRYRKWQLLETLIKASPPMCPLTMDELNRWRKYDNENGNEYPSSPEFLAWIRLDFDGDNISDFINPYELRALASKQKINNPLILGRIFYHITQRRGFKGRDEAESETILKGSDEKGIAGADATLNIMKDKNVSLSEALLIDHNENLKRIRNRYSLRKLVEEELKSICLKNEIDIESELYKNLAKSILWQRPLRTQKGNIGKCTFEINKPRCPISHPLFEEYRALAFLNNIKITNLENNEEQNLSLEEKEKIISKLFLRKSKPTFDFSEIMKLIDPNKNQYKFNFKDYVSVSGMPVTAALKELFGCNVYEISINKASSANGEKGYYDYEDLWHVLYTFTDSESLIKFAKSKLQLSDEDSVKFSKIKIPQGFAALSINAIKKILKYLHQGYIYSDAVFLANLSKVLDQSLTSEEEEKLIANVHRLMINQRSNKNKSAIINNLISNYINNEEMNGKKESSYISDDNLNKLVENEIINVLGNNRWIELGEQNQNHLINEIRDNFKNLLITRGNFSRGVLYDKVPRFDDQIKTLLKKEYPEWDEERFKYLYHPAESEFYPAAKEIDGKKILGSPEPISKGLKNPMALKTLYVLKKLINHLILTEKIDSETRVVVEIARELNDANRRAAYERWKNERQKENESLVDKITQSASEAGYPDISVDDNILTKYKLWLEQGMQCLYTGKVIAFSELLNGTSVDIEHTIPASISFDNELSNLTLANSRYNRDIKKKLIPTQLPNYNTTIEINGESYKAILPNIKFIENKVKHYSKLVEDAKKKSKSAQSKDQKDTQIQNRHYYKMHYDYWNKKLRTFTDTEIRSSWKNSQLVDTQIISKYAFHYLKTVFNIVDVQKGSVTAAFREIFNLGFKKDRNSSIHHAIDAATLTLIPYPKKRDYLLLKYFEATERKLAFHSKPEYWNNFSSEIIKELEEKTFVNYYKKDTTLVQTYKNVRKRGRIQYIRKQLANGKFEYILDDKGNKIPMVSQGDAIRGQLHKETFMGAIKLPLNNTGIRGNYKTSDKPLIFVERVPLKSLKKMEDLKKIIDDKVKGDIQKTLERKISQGKSFVQAINEDFWLLDKNGNEIKQDKNEKVLFPMRHVRCISSAGGGILTPEKALQIKQQTFLSEHEYKQYYYAQNKEMALCIFYEKNVKNKLLREFRFAGLFELAQLKIKNVNELATIPEYNLLEKRHIPSKYFIKTGYRVIVYENSPDEIRELNPDELIKRIYRVYKFNDSGANYIFLQYNSESRKDKELGEGSTKFDLSIYQPRLKLTANNFNCLVEHYDFNISIDGEIIFK

SEQ ID NO: 1114 - protein, 1260 aa, Streptobacillus felis
MKYNLGLDLGVASIGWAVTRVNESGEPLELIDANSVIFKPLDNDKGKLYNEERRNKRGARRILRRKQYRIERTKTLLLEKGLLNENELNNIYEGKIEDIYSIRIKGLTEQLSKYEIARLMIFYCKNRGFKSNRKTDELELLESLKKKVSDNDSDEKKLKPIIAKNTELIESKGLTPIEIIYMTREEDKSILGFKNKEGHYKFGFKRNQIIDEARKILENQKILNKDIIDSYIEILSSQRDFSDGPGGESKYKIDYSKLAGKCKYTGEVRAVKASPSYEIFIMLQKLNDLRYLNLDSENKREKRRLNSEEIKKIFDLVFNKDKKLTFSLIEENIEAKNIRILDVPQLSKNDYTKLRKSTFGETRKEDITEDEITNFNDKLNKERMKQELVKNNLASYKKLKNDFKKNNISGERIEELGGIDFLDLVAEILTYAKTDSKVDYYVNEVDRYSIFKNAKDVVEVMKGLPNYTKNGNLSLSLVKKLNEKMLEGLDYESSLSSLNYYINTNTDWKKFPTVSQIEDVLNTKVTNPNVKHILVILRKLYNTLLFKYGRPEKVHLELARDFSNDFSTRNSIKREQLDNRVRKEVAAFEMYGENRDIVLGKDKLSQEDFVRIKLWEEQNKVCMYSGKPIERRQLISAEVQVDHILPYSKSYDNSYSNKVLVLSKENQDKKERTPYQWLKGTSKWDEFKRRVELNINISNKKKDNLLFRDEVVKDDFLERELHATSYSSRLALNIFQRLIPVSEEDKYDENGNEKVKYIYNRNVVAFNGKMTSKLRSLYGLNRLTHNFESGNLEINNKLYYLKEFELGKESIKINAYNIETGFEISTETKVEKNKSGEYKTLKDEILQKELTKKVNLEKLSETFKDKVLFDLKIVDFENLENLDIEISQVIYKMITNLKEQVYRKNRDNHLHHALDAFLLSIMNKSMQIKLTKFNQLISSLKNREDEIFIEEKGEYVSSKEFAEELSKDRIIDLDGNEKGIKVNIEGKEFKLGITKPYDNFLNDIKFKIFDKRENPKLPYHVVKSKVNGALHAETILGESKGEITKRVSVFTLDEKKLEKIFDKDGSQKEIYETLAKWIKTKSKDYPKLKNGNIIKKVKLVDGNKDKLIKLGEKRYAEMGQTIVKILVFEKEGENGLRFASLGRYNYNQMKKGNDFEILIWKGQGEKNSHMVKFSKLNQNGYKLIQELVSNECIELELNNGAKSECLVVGFTSGKFEVASILGDDLDLMDSSIIKTILKQYQITISTIKSIKKVNRNILGD

SEQ ID NO: 1115 - protein, 1398 aa, Veillonella parvula
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYTDQDYYKAYPTIYHLRAELMKDGTYDIRKLFLAVHHILKYRGNFLYEGASFDSNASTLDDVLKQALENITFNCFDSSAAIGSIGQILMETGKTKSDKAKTIERLVDTYIITDEVNASGKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNAMFKVDEKGLHNYVHYIKQGRTEETSCNREDFYKYTKKVVEGLPDSKDKEYILSEIELQTLLPLQRIKDNGVIPYQLHLEELKVILAKCGPKFPFLNEVADGFSVAEKLIKMLEFRIPYYVGPLNTSHNVDNGGFAWAVRKASGRVTPWNFDDKIDREKSAAAFIKNLTNKCTYLLGEDVLPKSSLLYSEFMLLNELNNVRIDGKPLETKVKAHLIKAVFKQDHKKMTKNRIEQFLKDNNYIPEKHKPEITGLDGEIKNDLASYRDMVRILGNNFDLSMAEEIITDITIFGESKKMLRETLRKKFASCLDDEAIKKLSKLRYRDWGRLSKKLLNGIDGCDKAGDGTSVTIIEAMRDFSYNLMELLGDRFLFMERIQEINDKLTEGQIVNPHDIIDDLALSPAVKRAVWQALRIVDEIVHIKKALPARIFVEVTRSNKAEKKKKDSRQKRLSDLYAAIKKDDALLSGLTNEEFGGLKSELAKYDDAALRSKKLYLYYTQMGRCAYTGEVIDLSQLNTDNYDIDHIYPRSLTKDDSFDNLVLCKRTANAQKSDTYPISKEIQKAQKAFWIFLKQQGLISERKYERLTRITPLTADDLSGFIARQLVETNQSVKAATTLLRRLYPDIDVVFVKAENVTDFRHDNNFIKVRSLNHHHHAKDAYLNIVVGNVYHEKFTRNFRAFFKKNGANRTYNLAKMFNYDVKCTNAKDGKAWDVKTSMDTVNKMMTSNDVRVTKRLLEQSGALADATVYKATVAAKAKDGAYIGMKTKSSVFADVTKYGGMTKIKNAYSIIVQYIGKKGEVVKEIVPLPIYLTNRNITDQDLIDYVASITPQAKDISIIYRKLCINQLVKVNGFYYYLGGKTNSNIYIDNAVEVVVPANIAVYIKVLEKFALLHKDNNNIKASTVTTRIYNEGSTNIVSITDKDGLIVYDYLMSKLRTPLYMKMKGNKVDELSTVGRSKFMNMTLEEQSIYLLEVLNLLTNSKTTFDVKALGITASRSTIGVKIHTLDEFKIINQSITGLYSNEITIV

SEQ ID NO: 1116 - protein, 1397 aa, Unknown
  NCBI_LOQG01000003:140180_12
MDKLKKQQFTDYYLGLDLGTSSVGWAVTDPNYNILKFNKKDMWGSRLFDEAQTAKDRRVQRNSRRRLKRRKWRLDLLERIFEEEIFKIDPTFFMRLKESNLHLEDKTYKKEFILFNDNNYTDKDFHNNYPTIYHLRDDLINTNEKKDIRLIYLALHSIFKRRGHFLFSGLSIDEIKNFQIVFENLKDSIKEILGFELDADRDNLNSILTNRTTTKKDKEKELKNILKNNQLLAIFKLVIGSKSNFKNIFIENETLQEKDNEINISFSDIIYDDKRDELVNILDEDIDLIDKCKNMYDYLLLKKILKQESSSISSSMIDSYNQHKVELKQLKYFIKKYCKEEYNNIFRDSNKNYSAYINLNSIDGNRKIINYSEEISKPEHLFKNLKSIFQKFGKINTEGTVVSEIIDESDKNIFKKLYEKTENHTLLARQRTTNNSILPYQIHKYELEKILENQSKYYEFLGIRKNEIIKIFEFRIPYYVGPLNNNSKHSWVVRKSGEITPQNFEDKVDLEQSAEKFILRMTNKCTYLREEDVLPKDSLIYGEYMVLNELNKVKINGSSDILIKYKQEIIDLLFKRNVTVTVKKLIEFLETKGIKVEKSEISGVEVKFNSSLKTYIKFFKIIGNKLEEDKYKNIVENIIRWKCLYGDDKKIFEKKFNSEYKNNELNKDEFNQILKLSFNGWGRLSAKLLTSQFDFVNLNTGEGPYKSVMEALRTNNLNLMELLSSNYDLMDKIEKENNENNEKGKNSTYKELVNESYVSPSVKRSIIQTIKIINEIKKITKKVPKKIFIETARTNEVKGKITEKRQEAIQKLYKSVEKDKDLIFEEIDSLNKEVKSFDNNKLRQKKLFLYFMQLGKCMYSGESIDISELNNSNTYDIEHIYPQSKVKDDSLDNIILVKKEINISEGDKYPKSSNIRNKMKSFWKILKDKKFISNEKYSRLICDKEMTVDQLSGFVARQLVTTRQATIEVIRILNILYPESEIIYSKAGNVSDFREKFDLIKCRELNDMHHAKDAYLNIVVGNVYNTKFTKNPTNFIKSQLNLDKKDSYNLKKIFDYDIERNNLIAWKKEKKDENGKVLKEGTISLVRNNILKNTVNITRMLIEDKGQLFNLTIKKKKENKDGDFIPAIKISGESQKLTSKYGYYDSLNPSYFVLLKYDDKNGNKQMIADRVFIKDLSKIKTHKDLEKYYEAKYKNPKIIKKIKKQQLILFDNYPYRISGYTNKSGLELKNAKSLFLENNYVKYLKDAIKFVLINEKNNENSYIFPKLKRDNNTRPETNEEAKARHEKEFIKLYNVFIEKLQSKEYANYCFNKRSIDLISQKEIFEKNSLLEKAKMLKCIIKIFNKDTNWQFTGKNDNLKLILTVSRSFKTFSKFNPGKLVFIDESITGLFNKKIIIK

SEQ ID NO: 1117 - protein, 1302 aa, Caviibacter abscessus
MNNLDYVLGLDLGVASVGWAVMEIDSDKNPVRLVDANSVIFKALDNDKGKLYNEERRDARGARRVLNRRKERIRRVKELLISSKFLSESELYNLYEGKLIDIFDVRKKGLTEQLNKLEIARLMIYYLKNRGFKSNRKTDDIELEEELKKLTKNNNKNQKNNGENQENSEESKKNNEKKLKPIIALNTKRLQEDNLMPIELIFKIKEEKNVTGFKNKEGLYIFGFKREQIEKEAQQILEKQKLISTELLEKYMDILKSQRDFSEGPALPSKYRIDWESKTGRCKYTGEKRVVAGAPSYEIFCMLQKLTDLRYIYIENDTKNGKYKLSSEQLNVIYNKVINEHKKLTYNLILSCIEDKNVRILNLPKLKLKDYIDITKKYLEKKQKKEEELTDEEKHELNYERNNKRNNEQLFELKHFNELIKQFKKNNISEDDIEKIGGFDFLDKIAELLTYAKTDKKLDEYYQKDRYKDIPKDVIEKIKTFKTFNQTGNLSLSLIKKLNAKMLEGNDYEKSLSSLGYSLVTDNNWEKFPTVLQIEKKFNTKITNPNVKHIMVILRKLYNTLLEKYGKPKKVHIELARDIANDFSTRNKIKQEQEKNRINREVKSLEIYSQNLDIFNHKDNISNEDYLRYRLYDEQNGICIYSGKKIEKSQLLTSEYQVDHILPYSKSGDNSYNNKVLVFAKENQDKKNKTPYQWLKNTEKWFQFKKRVELNTKIKDKKKNNLLYTDNVEKNEFLERDLHATSYSSKLALQIFKSLIPTDEKDMYDEKGEKKEIYIYNRNVIAFNGSMTSQLRKFYGLNRFTHSFESENLKLEKNYKFNELLCTENKLELTAKNEKTGDIIKKEYKVEKDKNTKDFKTEKDRIISNETLQMKNISKISEKLKNKYIENLKEKDFVGMIEFSSMELISTVFELCSQIKQEINLKNRSNHLHHALDATLLTIMNHSMQQRLTKFNQVLQQMSNSPKEYLNEETGEIMTYKELLEKMREDTETKSVDLYNNKTVQHYKIPGTNETFSLSLPYINFIEEIKNIIFIKNENSEEAKLPYHVIKSKTKGKLHSETILGESKGQVTKRVSVLKLYDKKWSKKKNIEEILKNLFDKEKSQKEIYETLKKWLSEKTKEYPKLKNGHIIKKVKMIDENKDKLIKLGNKRYVEMGQTIVKILVLRNKNKDGYRMASLGRYNHINIKNGKDFKLQIWQAADNLENIVEYSKLKNDYDKITELFPGEVIELEIKDGNKIICLVNGFTEGKLSVETILGDYTDVVRNKVFKTISSSKQYPKTISQIKNIKKLKYNILGDKICPLDKF

SEQ ID NO: 1118 - protein, 1360 aa, Oceanivirga salmonicida
MKIKQKFPNYYIGLDIGTNSVGWAVTDEKYNIFKFNGKRMWGSRLFDEAKTAAERRIFRNSRRRLKRRKYRLDLLNEIFENEISKIDKNFLQRLKESTLHLEDKSINEKYTLFNDKNFTDINFYEKYPTIYHLRKELVENTEKKDIRFIYLALHNILKKRGHFLFEGQNLTEIQEFESIFIKLSEYVYEKFGIELNLNLINEIEKILLDKKSGKLDKTREFKKIFDKNNQLISIFKLSIGSKVKLSDLYATDEYKEAEKKDISFDDSIYDEVKDIYFGILGEENITLLDICKAMYDFRILKNILHGSKYISESKVKEYETYKKDLKNLKYIMKKYYSRDDYNKLVKKSSIDELSEKTKSILEKIKNIDEEDKKIYENLLDRAKEQKILPKQKTNKNGVLPYQVHEVELEKILENQSKHYNFIKENKEKILSIFRFRIPYYVGPLNKNSDKAWFVRKSDGAIKPWNFSEKVDLEASAENFIKNLINNCTYLKNEKVIPKNSLLYEEYILLNELNKVKIDSNFLSVQDKENIINYLFKKENNVTLKKFKDFLVINNISSKDSVITGIDGKFNAKLSTYIKFKNILGNKIEEDRYVNMVEDVITWKCLYGKDLKLFMNKFNSKYSDLELSKEELNKIKNISIGTFGRLSRKLLSGLDFVNLETGEQYDSVIQALRKTNMNIMELMSKKFDLEKKIQILNSEFNKEKSYKELVDESYVSPSVKRAIIQSIRIIQEIVEITGKEPKKIFIETAREGNTGADKTKTIPRKEQILNIYESMYEANIDLQEQINDMKGKISEFDNNRLRQQKLYLYFMQLGKCMYSDEKIELSNLFDSNIYDIDHILPQSIIKDDSINNTVLVLKNINAKKTNEYPLDLDIQQKMKKYWKRLLDTNLISKIKYERLIRQNKLTDTELSGFIARQLVTTSQATNEVISILKNIYNKSDIVYAKAGNVSNFRSQYDIIKCRELNDFHHAKDAYLNIVCGNIFDTKFTKNPYIYMKKLKEKNDEFKYNMSKIYEREVKDIKNDNKIIWNDDIRENVLKIVDRNDVNVTRLSQIGSGELFDATIYKKGSPKGSGTEIQVNIPKNYSGNDENINEKYGYYKSLKNAYFLLINCEENGEKVKKIAKILIKEKNKFENSHDKFKYLEENKGIKNIKSIRKMKIGQKLIVDDFIYSIAFVSSNLIFKLNNEFSLLLDKKNTKILKNAINFLEKNKKDSDKYIVSFLKRDENKNKNEIYEEAIKRYDIEFNQLYKSICKKLASKIYINSKKPNLSIKYFNLIDIFEKIDLYNKAKFIVNIVKMLGTGSKGVVNMKEFEKIFNEYSKEKISFSAIEGIIQLSSSTLLKLDAYLLDESITGLFVKKTKI

SEQ ID NO: 1119 - protein, 1351 aa, bacterium P3
MKILGLDLGTNSIGWAVVNEAENERESSSIIRLGVRVNPLTVDEQNNFEKGKPITTNADRTLKRSMRRNLQRYKLRRANLVSLLKTQGWITDETLLSEQGNNSTFETYRLRAEAATKEITLEQFARVLLMLNKKRGYKSSRKMKHDEDGSFVNNLDIARELYDSGLTPGQYAYNLLKDGKKYIPDFYRSDLQEELDKIWAYQYEYHENILTHSLRSAIIDQSKTGTTKIFLKTHGIFTADIKGNRNERNKQLFELRCGALERALTAEELATVIAEVNGQINSSSGYLGAISDRSKALFINHQTVGQYLMQQLDRDPNKSLKNQPFYRQDYLDEFEQLWETQAHYHPELTAALKHEIRDIIIFYQRRLKSQKWLVANCPFEHRKVCPKSSPLFQHFRIWQVLNNVTVTVDNKTYVLNEEQKSILSKELLYKEKISKRDALKMLFVKAKGVDMNFASLEGDRTMSNLLKAAQEIVSISGHGDYDFGKMPADDIHNIIRSVFGGLGFATDWLNLDTDADDLEQESQMRLWHLIYSFEGDNSTTGDTKLVERLMSLLNLPQEYARLFANVHLEDDYCGISSKALKRILPFMKAGHIYSEACALAGYKHSEQSLTREENKNRPLKDHLEQLPKNSLRNPVVEKILNQMVNVVNSIIDTYGRPDEIRIELARELKNNALGRQAIFEAINRNTKESERIQQILKKEFGLTHVSRNDIIRYRLYQELSGNGYKTLYSNIYIPQEKLFSKEIDIEHIIPQARLFDDSFSNKTLEYRDVNIKKSNTTAIDFVRNEYGENEVEQYKKRVNDLLKSGAISQAKAKKLKMTEAEIPNDFIERDLRNTQYISRKAQEMLRDVARVVTATTGSVTDRLRQDWQLVDVMQELNWDKYERQGLTTVINGRDGQQIRRITDWTKRNDHRHHAMDALTIAFTKPAYISYLNHLNARSEDDIRSIERRFLERDANGHLRFISPIAHNFRSEAKRHLEMILVSIKAKNKVVTRNNNTTKTKGGRRNRIQLTPRGQLHDATVYGSILLPHTKTIAVDGKMTAEIIGQVQNPVFRQALSQRLEACGNDPKKAFTGKNSLEKAPVWIDQAHTEHVPAEVTIQRLEPQHTIRRAVNKDLNINKVLDKGIQHILQARLDAYGGDAAKAFANLDNNPIWLNQEKGIAIKRVTTAENISGEPLHHKHDKEGRPILDTNGKPMPSDFVRLMNNHHVAIFQDADGNLQEHIVSFYEAVARVTELGLPVIDKEYNKDKGWQFLFTLKQNEYFVFPNPAQGFNPDEIDLTDERNYSRISPNLYRVQKMSSKYYVFRHHLETTVEDKKELQGITWKRIQSLNNLKGIVKVRIDHIGRIVQIGEY

SEQ ID NO: 1120 - protein, 1086 aa, Anoxybacillus sp. P3H1B
MNYKIGLDIGITSVGWAAINLDLRRIEDLGVRIFDKAEQPQGDPLALPRRLARSTRRRLRRRKHRLERIRRLLVRENVITKEEMDNLFTKRGLTDVWQLRVEALDRKLNNDELARVLLHLAKRRGFKSNRKSERNSNENSVLLKHVKENRSILDKYRTVAEMIVKDEKFQYHKRNKADDYSNMIARDDLQREIQLLFAKQREFNNPICTEHFEAAYLHIWSSQRPFASKDDIEKKVGFCTFEPNEKRAPKATYTFQSFVAWEHINKLRLVSLDGTRPLTEQERQLIYKQAFTKNKITYHDIRKLLDLPDDIKFKGLVYEVDQLLKKMENIRFLELDAYHKIRKCIEQVYSKKGVDQFSEADFDTFGYALTVFKNDEDIYAYLQNEYVRADGKKVCNLANRAYDSALIDELLNLSFSKFGHLSIKALRNILPYMEQGEVYSRACELANYDFTGPKKKEKTRLLPTIPDIANPVVMRALTQARKVVNAIIKKYGSPVSIHIELARDLSRSFDERKKVQKEQTENRKKNETAVKQLMEYGLTKNPTGLDIVKFKLWSEQQGRCMYSLEPISLEHLLDEGYTEVDHIFPYSRSLDDSYANKVLVLTKENRQKGNRTPAEYLGVGTERWNNFEAFVLTNKQFSKAKKNNLLRLHYGETEEKEFKERNLNDTRYISRFFVNFIKEHLKFADSNRNQKVYTVSGKITAHLRSRWDFNKNREESDLHHAVDAVIVACASPDIIEKITRFYQEREQNKELAKKKEPFFPQPWPHFSDELKARLSKFPQESIKVLNLGNYDNSKLESLKSVFVSRMPKRSVTGAAHQETLRRYIGEDEPSGKIQTIVKTKLSNIKLDADGHFPMYGKESDPRTYEVIRQRLLEHGNDPKKAFQQPLHKPKKNGEPGPIIRSVKIIDVKNRVVHLDEKTVAYNSNIVRTDVFEKDGKYYCVPVYTIDIMNGVLPNKAIEANKPYSEWKEMTEDYTFKFSLYPNDLVRVEFPREKVVKDSLGREVKVKDIFMYYKTIDSATGGLDLISHDQSFSLRGVGSKTLKRFEKYQVDVLGNIYQVKGEKRVGLASCHDQKTEQTVDSLQSASD

SEQ ID NO: 1121 - protein, 1379 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFADEMAKVDESFFQRLDESFLRWDDDNKKLGRYPIFGNKADVVKYHQEFPTIYHLRKHLADSSEKADLRLVYLALAHMIKFRGHFLIEGELNAENTDVQKIFSDFVRVYDRTFDDSHLSEITVDAASILTEKISKSRRLENLIKYYPTEKKNTLFGNLIALALGLQPNFKMNFKLSEDAKLQFSKDSYNEDLEELLGKIGDDYADLFTSAKNLYDAILLSGILTVDDNSTKAPLSASMIKRYAEHHEDLEKLKEFIKANKSELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDVHKLIAKSSDDHSEMGKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 1122 - protein, 1373 aa, Streptococcus equinus
MEKTYSIGLDIGTNSVGWSVITDDYKVPAKKMKVLGNTDKKYIKKNLLGALLFDSGETAEVTRLKRTARRRYTRRKNRLRYLQEIFAKEMAKVDESFFQRLEESFLTDDDKTFDSHPIFGNKAEEDAYHQEFPTIYHLRKHLADSSEKADLRLVYLALAHMIKFRGHFLIEGELNAENTDIQKLFNDFVETYDKIADESHLSEVDASSILTNKISKSRRLENLIKQYPTEKKNTLFGNLVALVLGLQPNFKTNFKLSEDAKLQFSKDTYDEDLEELLGKIGDDYADLFTAAKNLYDAILLSGILTVDDNSTKAPLSASMIKRYEEHHEDLEKLKKFIKVNNFDKYHEIFKDKSKNGYAGYIENGVKQDIFYKHLKSIISEKNGGQYFLDKIEREDFLRKQRTFDNGSIPHQIHLQEMRAILRRQGEYYPFLKENQSKIEKILTFRIPYYVGPLARKNSRFAWAKYHSDEPITPWNFDEVVDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKSFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQSSLKELGSNIINEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLAPEFVYGEYKKYDVRKLIAKSSDDHSEMGKATAKYFFYSNLMNFFKTKVKYADGSVYERPIIETNADGEVVWNKQKDFEIIRKVLSYPQVNIVKKVEEQTVGQNGGLFDNNILAKPEKDDKKKLFPIKKSLSTTSYGGYARATIAYSILIVSEFGKNKELKLLGLPLLDKVKYEKNPIAYLNSIGIINVKSIFKLPKYCLFEFQEKNTNYRRYMVSNQELKRANQLFLTCKETELVYKYIKSDNDNTHLVGNEKTILSIWNKLVIFMERTKLIDKKLFASLKQLKDEVNLINILDIASKSIDFTKISAGQKKIVLNDSLSLPIKRWQFKSDEKMLKQLNDATLIHQSITGLYETRIDLSKLGEE

SEQ ID NO: 1123 - protein, 1380 aa, Streptococcus gordonii
MKKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLEEEKEYHKKFPTIYHLRKHLADSKEKADLRLIYLALAHMIKYRGHFLYEDTFDIKNNDIQKIFNEFISIYDNAFEGSSLSGQNAQVEAIFTDKISKSAKRERVLKLFPDEKSTGLFSEFLKLIVGNQADFKKHFDLEDKAPLQFSKDTYDEDLENLLGQIGDDFADLFVAAKKLYDAILLSGILTVTDPSTKAPLSASMIERYENHQNDLVVLKQFIKNNLPENYVEVFSDDSKNGYAGYVGVDSKIRKRNAKLATEEEFYKYLKNILNNVKGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEDFINKMTNYDLYLPEEKVLPKHSLLYEKFAVYNELTKVKFIAEGLRDYQFLDSGQKKQIVNQLFKEKRKVTEKDIIHYLHTVDGYDGIELKGIEKQFNASLSTYHDLLKIIKDKEFMDDPKNEEILENIVHTLTIFEDREMIKQRLAQYDSLFDEKVIKSLTRRHYTGWGKLSAMLINGIRDKQTGKTILDYLIDDAYYNRNFMQLINDDGLSFKEIIQKAQVVGKTDDVKQVVQELPGSPAIKKGILQSIKIVDELVKIMRHNPESIVIEMARENQTTARGKKNSQQRYKRIEDALKNLAPGLDSNILKEHPTDNVQLQNDRLFLYYLQNGKDMYTGEALDINQLSSYDIDHIIPQAFIKDDSFDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLKRYISRSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILWDTTKYGGFDSPVIAYSILLIADIEKGKAKKLKTVKTLVGITIMEKAAFEDNPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETRIDLSKLGED

SEQ ID NO: 1124 - protein, 1053 aa, Comamonadaceae bacterium CCH4-C5
MKQLKSNSRYRLALDLGSTSLGWAMFRLGQDGSPTAIIRSGVRIFSDGRNPKDGSSLAVTRRAARAMRRRRDRLLKRKSRMLGQLVRHGFFPADEAARKALERLNPYQLRAKGLREALTPGEFARALFHINQRRGFQSNRKTDRKDNDSGALKQAIHQLRERMAASGCQTVGEWFWQVRMQQKPEGVAGQGVRARYRETPYTTDEGKKRIDKSYDLYVDRAMIAQEFDALWAAQAALQPALFTEVARADLRDTLLHQRPLRPVRPGRCTLLPDEERAPLALPSTQRFRILQEVNHLRLLDGTLSEVPLTLAQRDTVVAALEAHSKRSFDQLRKLLKLSGSVRFNLEDAKRTELKGNATSAALARKDLLGAAWAGFAAELQDEIVWQIVNEEGEGTLIAWLQQHTGVDEARAEAIANVALPEGYGSLSRKALARIVPELQRDVVTYDKAVQASGFAHHSDLGFDFDHDSDEVERVGERTIASTGEIKPVYAFKELPYYGRALQRHVAFAKDKPRNDEERYGKIANPTVHIGLNQVRVVVNALIRRYGRPAEVVVELARDLKQSREQKQEAQKKQADNQRRNARIRERVAETLGISTERVRASDIQKWILWEELSFDVADRRCPYSGVQISAAMLLSEQVEIEHILPFSQTLDDSLNNRTVAMRQANRIKRNRTPWAARADFEAQGWSYEGILQRAERMPLRKRYRFAHDGYERWLGEDKDFLARALNDTRYLSRVASEYLRLVCPGSATRVIPGQMTAMLRAKFGLNDVLGLNGEKNRNDHRHHAVDACVIGVTDQGLLQRFAQANAQAREGGLTRLVESMPLPWDTYRDHVERAVRHIWVSHKPDHGFEGGFLEDTAYSPPMSNQSGMWVTRGINGVKPNQRDAESLTMIPIARYGRGPRALVEPVDKTVFKGYVGGSNYCIEITRNAQGKWEGDVISTFKAYGIVRAGGWAQLRNPTQGQNGQPLVMRLVIGDSVRLEVEGREQTMRVVNINGNNGQMFMAPVHEANVDARNRDKQDAFAYTSKYAGSMQKAKARQVTISAMGELRDPGFQG

SEQ ID NO: 1125 - protein, 1368 aa, Streptococcus pyogenes [sequence omitted]

SEQ ID NO: 1126 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 1127 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 1128 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 1129 - protein, 1345 aa, Belliella baltica
MKKILGLDLGTTSIGWAFIKEPEKDVVGSEIVDMGVRIVALSSDEENDFAKGNTISINADRTLKRGARRNLQRFKLRRDALLEIFKEMKLIPSNFKYAEDGPSSTFSTLKLRDKAAKEKIELDDLVKVLLQINKKRGYRSSRKAKSEEDDGSAIDSMGIAKELYENDLTPGQWVFEALQKGRKNVPDFYRSDLQEEFKKIVNYQSEFYPDVLNSSFVEDWMGKASTPTKQYFNKKGVHLAENKGKREERRLQEYNWRAVAVNSKIDLSEIALILSQINSQISNSSGYLGAISDRSKELYFKNQTVGQYLYQQIKINPHTRLKGQVFYRQDYLDEFEKIWSVQSGFHPQLNDALKKEIRDITIFFQRRLKSQKHLISNCEFEDYHKVVPKSHPIFQEFRIWQNLNNLTLIKKDNLNEKSELALEDKIALANELAFKREQSVKDALNILGLKSSEWEFNFTKIEGNRTNHAFFEAFAKIIEIEDGEPLDLGNLKADDILDQFSEAFLRIGIDPGLLQVNNDIEGPNYEKQPYIQFWHLLYSSEDDQKLKQNLIKKFGFKPDHAKILASISLQDDHASLSSRAIKKILPHLQSGLIYDKACTYAGYNHSSSFTKEENEKRELSSELDLLKKNSLRNPVVEKILNQMINVVNAILKDPNLGKPDEIRVEMARELKANAEQRKNMTSNIASATRDHEKYREILKKEFGLKRVTKNDLLRYKLWLETDGISLYTGKPIEASKLFSKEYDIEHIIPKTRLFDDSFSNKTICERQLNIDKANVTAFSFLQNKLSGDEFEQYQSRVKSLFGKLSKAKIQKLLMANDKIPEDFIARQLQETRYISKKAKEILFEITRRVSVTTGTITDKLREDWGLVEIMKELNWEKYDKLGLTYTIEGKHGERLNKIKDWSKRNDHRHHAMDALTVALTKPAYIQYLNNLNAKELNGKKSTEIFAIEQKYLKRENGKLCFIPPVENIRTEAKKHLSKVLISYKAKNKVVTINKNRTNKKAGFNEQIALTPRGQLHKETVYGKAFHYSTKFEKIGASFDVQKINAVAKKEEREALLKRLAENGDDPKKAFTGKNSLSKMPIYLDLKRNIKLPEKVKTVVLEQNYTIRKNIDPDLKLDKVIDVGVKRILENRLKEFGGNAKLALSNLDENPIWLNKEKGITIKRVKISGVSNVESLHVKKDHFGEPILDQVGNEIPVDFVSTGNNHHVAIYEDEKGNLQEEVVSFFEAVVRQNQGLPIINKNHSLGWKFLFTLKQNEYFVFPSDDFDPTDVDLMDEENYHLISPNLFRVQKFTTKDYFFRHHLETTVEDKSELKGVSFKRLGLPGLNCIKKIRINHLGKIIQVGEY

SEQ ID NO: 1130 - protein, 1439 aa, Lactobacillus delbrueckii
MRNKEKKKGKRKMAKPKDYTIGLDIGTNSVGWVVTDDQNNILRIKGKKAIGARLFAEGKVAAERRSFRTTRRRLSRRRWRIKLLEELFDKEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERTILSVQTLEELNDLFAENEGTEEAKLNVASAEQINDILTGGHLNADSQKEIGNLLLPSSFPSFDDKAKEKQVKKLIKNVATNISKAWLGYKADFSTILNLANVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVNNRHADLAKAMKLTGIKKRSELLDPEELKKAISSLLDDSPEAVEIKQMLEEKTFLPLQRSNNNGVIPNQLHQVELDEIIKKQSKYYPFLAEKNPDESEEAQKKAPTKLDALLTFRVPYYVGPMITKEEQEAQDGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQNDFEKIIEYSTIFEDRKILEDKLRADFAWLSEEQIKQLCRLRLQGWGRLSDKLLTRLTDADGQNVLERLWNSNDNFVQIVSDPNIKAKIEQENQKLLRDGQSDDAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDIDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDYHHAIDAYLSTIVGNYLYQVYPNLRRMFVYGEFKKFSSNAEESAYDVVRRVKSMNFLDDLLRGTHGDNIYCRSTGEIVFNRNDIISKLKQAYSFKQMLVTQEVFTKKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKDTGKPIKGIKDVKILMDKIPCRQPVLEGESYYMLASSKYRYSLKQISLSQMSMKYILDYIDDPNFNKHEMINIDQQDEKECLLSVYDEILEKMDKYLPLFDIRSFRKKLHDGRDAFIALPVASEEKKPGKVDVIRKVLKGLHANADITNLAELGFGTAALGALVSTGGIKISDDAVFIYQSPTGLFERRVKVSDLLK

SEQ ID NO: 1131 - protein, 1292 aa, Unknown
  patric2_AUOT01000254:684847656_17
MAKILGLDLGTNSIGWAIRDTNKEGNQIVDSNVIVFPQGVGEEKGVEFSLASERTKHRASRKLYRRRKQRKTDLLNLLIDNSFCPLTTDELLLWSVYKKGQEMKYPTENHDFSEWIKINPYEVRAKAVSSSISKLELGRALYHMCQRRGFKSGRKDADAGKDLIQFQKEKDLLEKNGFKTLGEYYFDLLQRNEKVRKTKFSDDDQEVNSSRISYVEEFNFLMKTQNIEKELADQFFEVIFFQRPLKSQKGSVGKCTLEKTKSRCAVSHPLFEEFRMFQYLNSIKVKERNNDSFVFLSDYPEYYKIAQDKFYRVSAKNFKFIDVSKSINTVAKKNNLFFEFNYNDKYPVVGSPTVSKLIEVFDADDWEECKTIIQSKYKKQDNKTIDELVDELWHTLFFAGDFVNDETSDKVKSFIRDRFLISEEKVNYYEGINLKQGYSSLSKKAIVKILPFLKEKIIYPYAVFFANVDAIVGKEKWKANKQFIQDTIIDIISRYKDEILKIDIVNGLVGDFIKQYDNSNYDYILDETDKQNVTEKIKVFYGKYAWENMPETEKEALQNEIEIIFQKQLQKRRVGGYYLSKPRIDEIIKDFLIQEYKVSKEQADKLYHPSAMDAYPQSQDGFLGLPFTNSIKNPMAMRTLFYLRKLVNTLLKENKIAPDTEIIIELARELNDKNKRLAIERWQRERENENKKFREKLEELAKDTNSIVTETDVIKYRLLQEQNGKCLYTNGTISCEKLLGSNPQFDIEHTFPRSKSFDNSLVNKTLADKNFNQIKGNQIPQNLDDKYKQNFINNTLHWKETIESLEEKIEQQKYFSKVASTVEQKNRAIQQRHYLKLELDYWKQKLYRFTATEIKPNFKNSQLVDTGIITKYSELFLKSLFQRVFPAKGSMVADVRKSWGLDVKDRNFHYHHAIDAVVLSCMDKNIRDGLAEAFRESEENRYSDKFKIKKPWNTFTEDINQLKNNIIVVHNHKNTIDRQTVKKLRKRNKVQYNKLGDVIYEKGQGIRASLHKDTFYGAIERENENSEKEIWFVIRKPVTNAFSESEVNAIVDEGIKTRILKHGLKNIKTPEGWILLPSEKDANGKEIKEMLIKKIRIKTANKNLPKIKAQSHISQGKRKEHKESYYATLENIFAMAIYETVNDKGKKEQTFNTISAFDLAKHNQGNRKLEMPVEENIFKNKGKKNEVLIPLSKVLKVNQMAIFYENNPEELKSISKENLSKRLFKITQFESDGRIQFRHHAQGGADKDLKKESSLDFEKSAQKLRISLSNIKAIYEGKDFILHPSGKIDFLI

SEQ ID NO: 1132 - protein, 1379 aa, Prevotella aurantiaca
MRKILGLDLGTTSIGWALVNEADNDNESSSIIRLGVRVNPLTVDEKSNFEKGKAITTNSDRQQRHGARINLQRYKLRRQNLRNLLQDQGWLSNEALYEEGKGTTFETYKLRAKAAEEKISLHEFARVLFMLNKKRGYKSNRKANNKEEGQLFDGMTIAKKLYEEHLTPAEYSFQLLSKGKKFAQDYYRSDLIAELERIWNEQKKYYPEILTDEFKQQLEGKTKVNTNKIFLAKYGIYSADLKGLDRKLQPLKWRIEALKQQVSKEILAFVISDLKGHIANTSGYLGAISDRSKELFFNKQTVGQYLWASLKNPHISIKSKPFYRQDYLDEFEKLWETQAAFHKQLTPELKHEIRDIIIFYQRPLKSKKGLISVCELEQRKVKVTIDGKEKEITIGPKVAPKSSPVFQEFRIWQNINNILLINNDTNEKHSLDEKERNLLYQELSVKVKLSKTDVLKILNKKGKQWDLNYKEVEGNRTQAILFDCYNKIISLTGREECDFKKLQASEIRHHVTTIFKNLGFNTDILDFNPSLVKHELEKQPMYMLWHLLYSYESDNSRTGNEALLRKLEIDFGFPKEYATVLCDVVFEDDYSNLSVKAMRKILPYLEVGNDYSQACAYAGYKHSRRSLTKEELDQKIYKERLELLPKNSLRNPVVEKILNQMINVINTIIDEYGKPDEIRIEMARELKSSAAEREKATRAISQANAENQRIREILERDFALSYISRNDIIKYKLYQELEANGFKTLYSDTYISKEKLFSKDFDVEHIIPKARLFDDSFSNKTLEARDINLAKSNKTAFDFVQEKYGTEGAEAYKKKLDILLSKEVISRAKYNKLLMKEADIPSEFIERDLRNTQYIAKKACEILGELVKTVTPTTGEVTNRLREDWQLVDVMKELNFEKYQKLGLADIVEDRDGRKIKRIKDWTKRNDHRHHAMDALTIAFTKPAFIQYLNNLNARSNKSNSIYAIENKELHREDNKLKFNAPIPIHEFRAEAKRHLSAILISIKAKNKVMTQNVNKIKTKQGVIKKIQLTPRGALHNETIYGTKKRPIITMVKVGAALDEATINKISNLTIREALLKRLAEYNGDAKKAFAGKNSLEKNPIYLNEEKTKVLPALVKTVEWETYHPIRKPITPDLKIEKVIDKGIRKILKARLAKFNGDAKKAFSNLDENPIYIDEAKKIALKRVSIEGVLSAIPLHTLKDQAGKLIIGKDGKPVLGNYVQTSNNHHIAFYYDEDGNLQDNAVSFFEAAERKSQGIPIVDKNYNHDKGWSFLFTMKQNEYFVFPNEATGFIPTEVNLMDEANYDMISPNLYRVQTISKIIYDKSIIRDYLFRHHLETTVERIPNLKGITYKQLKSLPHLKGIVKVRINAIGKIVAIGEYD

SEQ ID NO: 1133 - protein, 1068 aa, Necropsobacter massiliensis
MTLRYILGLDLGIASVGWAVVEIDENGYPIRLIDLGVRAFEKAETAKEGKSLNEERRLARASRRLIRRRVQRLKQAKRLLKENGVLLPSDFISSQLQLPINTWQLRVKGLSEKLERQEWAVVLLHLIKHRGYLSQRKNEAQTENKELGAMLGGIAENQKLLQSAEFRTPAEIAVKKFVVEAKHIRNQRGSYAHTFNRLDILAEMQLLFQKQRELGNPFTSANFEKNMTACLMFQKPALSGEAILKMLGHCTFETDQYKAAKNSYSAERFVWLTKLNNLRILHEGEEFALTEEQRRSIIDEPYKKAKLTYAQVRNLLKLPETAIFKGVRYRQDKVAESATLMELKAWHAVRKALESNNLKTEWEELKTKPELLDEIGTAFSLYKTDDDIRAKLGDKLPEAVLECLLAQLNFDKFINLSLQSLAKILPLMEQGVRYDEACQQVYGDHYGSKTKQNEIFLPKILADEIRNPVVLRTLTQARKVINAVVRRYGSPDRVHIEIARELGKSFQDRQKFIKQQEENRKARERAGENFREIFPHFVGEPKYKDLLKLRLYKEQDGKCLYSGKALDLTRLLENGYVEVDHALPFSRTWDDSQNNKVLVLKAENQNKGNRTPFEWLGGVENSDRWKMFKVNVEMSAFSYAKKQRLLTQKLDEKGFKDRNLNDTRYISRFMMNWIADNMLLKGKGKRQVFAPNGQITALLRGRWGLTKNREESDRHHALDAVVVACATVSMQQKITRFMQYEAEHPYRQNLGRVDVETGEIIPLHFPAPWEYFREEVMIRVFSDVPKEDLTIQLPARLEANHEFVQPLFVSRMPTRKMTGQGHKETVRSAKRLEEKISIKRVALTELKLDLLENMANCEREVELYQALKERLNAFKNDPVKAFAEPFYKKGGQLVKAVRVEFLQKAGVLVHQGAGVTDNATMVRVDVFKKNGKFFLVPIYTWQVAKGILPNKAIYGSDEDNWLEIDESYQFLFPMYPNDLIKIVKQEGKLQNEYFGYYKELDRSDARIIISSHDRDIRKGNVKQKGSDKLTGKFRISTKSKVISFEKYEIDELGKNIHLCRYSKRPNVR

SEQ ID NO: 1134 - protein, 1022 aa, Helicobacter pametensis
MKIKTLGVDIGIASIGWAVVEGEYIDGNLKNEQIIDSGVRIFTKAENPKTKESLALPRRNARSARRRNARRRARVQQVKSYLCQTLGLDSKDFIQEGNLAPIFQTSKDFLSPWELRERALYRVLDREEFARVILHIAKRRGYDDITYGIEGKDDDGKIKKAIKENNALLIESKSQTIGEMMFKQYYSQSLNVRNKKENYNRCVGRSELRDELEKIFATQQKLGNPYITQDFIHKLLGNPNAESKQVKEGLIFYQRPLKGFQDKIGRCQHIKGESQAYRACKNAPSAEEFVAITKIINFLANLKNLYGDVSLSPKEGIQKIMLEAQKNKKGLTYSKLKALLDLPSDFEFAGLDYSGEKSPEGAVFLSLPSTFELSKIIAEREMQDKIADILGANKDWEIILKEFKKLDLSQDQIQAIKDAKLSFSKHINLSLEALYHILPLMREGKRYDEAVQILQEQGIFSKPQNKNLQLLPPLSELVKEDSYFDIPNPVLKRALSEFRKVINALLEKYGGFHYFNIELARDVSNGKKRRNELERINKENQKENDEATTLLRTLGIPNTSKNRLKCKLWRQQGEQCLYSGVNITADHLRDEKLLQIDHALPLSRSLDDSQSNKVLCLTSSNQNKLDQTPYEWLGGDEKKWNAYVGRVYASKFSSSKKRKLTLKNFKTKTTDDFLARNLVDTGYIGRVVKEYVKTSLSFLPLPDGKKEYIRIISGSMTSAMRSYWGIQDKNRDHHLHHAQDAIIIACIQPNMIQKYTKYLQDKETHKLKSSEKAQLLKEGDYKTKLTLRWSMSNFGEKMQESIQKIIVSHSVSYKVTGALHEETVRKKEFYYKSFGGEEGVKKALEFGKIRAVNHGIVDNGAMVRVDIFKSKDKGSFYAVPIYTYDFAIGKLPNRAIVQGKSNGVLKDWIEMDENYEFCFSLFKNDCIRIQTKEMQEPALVIYKSTDASNATIKIEHLSKYSCTQDEKILFKLKDNKLPMQGKQGIWGLKLFQKVKLSPLGEVIECKPRNRQPISLKSTPKNV

SEQ ID NO: 1135 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 1136 - protein, 543 aa, Prevotella histicola
ALYEEGKTSTFETYMLRAKAAEEEISLHELCRVLFMLNKKRGYKSNRKANNKEDGKLFDGMTVAKKLYEEHLTPAEYSLKLLSSGKKFKQEYYRSDLKEEFDRIWNEQQKYYPEILTDDFKQQLQGKSKGNTSKIFLGKYGIYSADLKGLDRKLQPLKWRVEALKQKVDKEVLAFVISDLNGQIASTSGLLGAISDRSKELYFNKQTVGQYLWTSLKESPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSNRPLYEEERNLLYEELSVKEKLSKAEALKVLNKNGKQWDLNYKEIEGNRTQAVLYDCYNRIIGMTGHEECNFKKLKASDIRYNVKTIFKNLGFSTDILDFDSSLQGHELERQPSYQLWHLLYSYESDNSRTGNDALLRKLETAFSIPKEYAAVLSDVVFEDSYGNLSVKAMRNILPHLQAGLDYSQACEKAGYKHSRRSLTKNELDKKE

SEQ ID NO: 1137 - protein, 557 aa, Chryseobacterium gallinarum
VLAETGKNTTFQTQYLRAKAAREKIELDELARVLLLINKKRGYKSSRKVQNDDDGKAIDGLSVAKELYEKNYTPGQYAYDLLKRGKKQIPDFYRSDLQNELDRIWEFQKQYHPDILTDEFKKELEGKGQRATAAIFLNRYKIYTADNKGTREEKKIQAYQWRVEALSQPLDVKEVAYVIAEINNNLNNSSGYLGAISDRSKKLYFNGQTIGEYLFEELSANPHTRLKNQVFYRQDYQDEFEKIWKIQTKFHPELTKELKEQVRDIVIFYQRKLKSQKGLISFCEFESREIEIEENGKRKRKKVGLKVAPKSSPLFQEFKIWQVLNNIEIKNEDERRYLEPEEKELLFNELNCKGNLTSQKCLELLGFKSKDAKLNFKVVEGNRTNEKLYDAFLKILELQGYNVFELLKIKEDKDEAKLSELKASADEIKGMIKEIFNANLINTSILDFNAELEGKDFENQASYQFWHLMYSYEGDNSPSGNEKLYELLEKKFGFKKEHSKILSTIVFSQEYGSLSTKAMRRIYPYIKDNKYSEACLLAGYNHSKHSLTKEELENRKL

SEQ ID NO: 1138 - protein, 575 aa, Parabacteroides sp.
TILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKV

SEQ ID NO: 1139 - protein, 578 aa, Capnocytophaga canis
TILTENGKGTTFQTLELRAKSAKEKISLGELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREELAFVITEINNNLNNSSGYLGAISDRSKELYFNNETVGEYLWKQIAANPHTSLKNQVFYRQDYLDEFERIWNTQAQFYPQILTESLKKELRDVVIFYQRKLKSQKSLVSFCEFENKEIEIKKEDGTSTKKVIGLKVAPKSSPLFQEFKIWQNLNNVLIRKKGSKTKKVAKTQQAVLFEEEKTISELDLEAKQALFNELNLKGNLKADYCLEILGYSPKEWEMNYPELEGSRTNKALYEAYLKITDLEGYDAKNYLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRV

SEQ ID NO: 1140 - protein, 601 aa, Ornithobacterium rhinotracheale
HYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWD

SEQ ID NO: 1141 - protein, 611 aa, Weeksella virosa
HYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVAD

SEQ ID NO: 1142 - protein, 519 aa, Flavobacterium frigidarium
HYVYAENGSNSTFLSYQLRAKAAIEKVSKEELVQVLLMLNKKRGYKSSRKAKSADEGDAIDGMKIAKEIFENNLTPGQWVYNSLLKEGKFIPDFYRSDLQKELERIVRFQNQFHSEQMNEKLLEDIQGKTRTQTSQYFTNAIKIPLTENKGSRDEVKLQHYKWRSEALTSELDLKILAYVITEINNQINQSSGYLGAISDRSKELYFNQETVGQYQYKQLQENAHNKLKNQVFYRQDYLDEFEKIWKTQARFHPELTDKLKTEVCDITIFYQRKLKSQKHLVSFCEFEKGHKAIPKSSPLFQDFRIWQNLNNIVIKNETTKEPFVLDEDLKKIISEELLFKESMTDVQMMAFCDLKKGNHSANFKKIEGNRTNTEIFKAFEKILILEGYDELDFSKLDASDIKQIFKSAFVDLGISTAILHFDPKIQGNDFDKQGYYQFWHLLYAAEDDDKLKETLKNKYGFKENHLPYLLNINLQADYGSLSAKAIKKILPHLMDGHIYNKACLMSGYNHSSSLTTEQ

SEQ ID NO: 1143 - protein, 437 aa, Rikenellaceae sp.
DLCPALSEEQLNAWQGKGIYPLDDAFIRWQRTDDNADRNPYRDRFRCLTEELDLACREERYVLGRALYHLCQRRGFLSNRKDAGNEAEEGKVKQEIKTLSADMAAAGCEYLGEYFYRLYQRKEKIRKHYTARNEHYLAEFRAICRKQRLDEELRQALEKAIFYQRPLKSQKGLVGKCTFEKDKSRCPVSHPRFEEFRMLQFINNVRVTGPGDAEPRPLSPEEVEIVRPLFLRKSKPHFDFEDIAKKIAGKGNYACRGELLQAPYRFNCAGKSTVTGSPVSALFASVFGDDWQREICSLYTLGAGKNEEQILNDVWHVLFAFEDEERLQAWLQEKLQLSADDAKTLAAFRLPQGYASLSLNVINKILPYLRRGYRYDEAVFFANLGKVLPAEVYADPARRREVEQGISAQMDDLGDGEKTRKEERIRDYLRRYWGVEE

SEQ ID NO: 1144 - protein, 640 aa, Jejuia pallidilutea
DEQELQIWSKYKKGSTRRFPENEKFLKWLACDFTYEEGENYKNPYVLRVKALNHIVTKHEFGRALYHIVQRRGYKDIGETDKETENQIKRRNDDGFKKALDIHGTVAKALNEEFLKKGKRARNQYPLREEYKHELEELCKAQGYNIQKEGKEGYKNKFVKSLWKAIIWQQPLKTQRGNIGKCSLEPTKPRSPISHPIFEIFRSWQFINTIRYYDDDGEKQVLSQKIKQALFYEKFLKKDSNFKFEEIRKFLDKRFQKAKRYNYPIDRKTGKYDTSVSGMPVCKGLINVFGEKAQSALDDMELYQINNAPKIIDKYSIYDLWHIIFEFDAEHLDKFATEKLKIQNKIVTRKKKQISISPLVELKEKFIQGYADLSLKALCKIIPFLKKGHLYNDAVILAKIPELLDTQWQEKRDLINEVLEKSNKLYNERKAIINIANNLIDKHKGLNHSEKFAYKDFEYALVPDDIEEIEKACVGYFGEKSWIKNKKKEEIIKEVGFEYQDYFHDTKRAYRKFPNFTEIFKDDLKENGINLKGELYHHSNRKNIYDNTLEINHETGEKYLPTYKDTGIEILPVPYIDSIKNPMFNKSMSILRKLINELIVAGEVDDNTEIIVELARELNDNNKRAAIERYQNLRKNNREK

SEQ ID NO: 1145 - protein, 510 aa, Caenispirillum salinarum
PVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPF

SEQ ID NO: 1146 - protein, 452 aa, Salinispira pacifica
KDELESYAKYRKGKKQEFPSSSEFNSWLKLNPYELRDRALHEDISRFEFGRILYHIIHHRGFKTGRKSNEDGALYKGNEDTVGVDETKNLLQQYATLGEYLNSLRIKSDGNERLRGRYTLRNWYVDEFNKIWERQAGKLGLENETVHSRNKRYYGPAGSSEHRRKLQAYKKAGISFEIEGDFICREQTVSLKDYLGNPDKGILFYQKPLKSQKHLLSKCRYEKRKSVCQISHPEFEYYRAMQFANQIEYGAGEKLNETDRKDVIILLLSKDKAVKMSDLKKKIQKTGVQFNYADDHKVPGSPTTAFISKVTDTSNVENIDWELFHSIWNDLVFYDKSEKLKEKFQRSYNIDVSIEQLNKYKINTDYSSLSLKAVRNINPFLQMGMLYNDAVIFAGIRRVIGEKSFDANADEIISHVSKLKEKNNRDVNQSFTDALREYVMQTFNISMNQTYK

SEQ ID NO: 1147 - protein, 380 aa, Sulfitobacter donghicola
GLMPSDPKQAKQLEALDPYELRARGLDETLELTELGRALFHLNQRRGFKSNRKTDAGDNESGKIIDATARLDWAMRDHRARTYGEFLHMRRQKADTPRTTPAVRTRLTIAARDGAEKEESGYDFYPDRQHLRDEFDALWEAQAEYHGVLTEDLRDEIGTIIFHQRPLKTPKVGKCLFTNEERVASAHPLNQRRILVETVNALRVAQLGEVARALTLEERDTILHALDNKAHTKSLSGMSIKLKALGKVIKLRSGQYFTLETANRDAIACDPVRASLSKPDRIGSYWSTLDHNAQWEVVNRIRAVQSDADHRELVAWLVSQHRLAAEHAEGAAYAPLPDGYSRLGITATKRILAALEANVIPYSKAVESCGWHHSDERTGE

SEQ ID NO: 1148 - protein, 362 aa, Mucispirillum schaedleri
FLLPSNEIERKALAVLNPYELRSRAVNERLELFELGRLLMHLSKRRGFKSNRKVDKEDSSGKIKPAIERLKNKMQETNKKTAGEYLYSLMQNGKPVRARLGRIDGSNGYEIYLDRALIEEEYNLIMNEQKKHHKELTDDIINEIFNIIFYQRPLKKQIIGKCSLTGEDTKLKKAHVLAQDFILLQKVQDLRVFDDNQLEFRPLSNDEKDIIKRELRKKKEVSYENIRKLLKKYYENVKYGMFSHETLYKKLQGNKTNALMSDKEIIGDSWYSLSPEVQYDIIEELYSDKDNDELSKLYSEKFNLNESQINGLLNKAIYRLDSGYIRYGKTAVTNLNSIMDKDNLNLHDAREEAGYEKENKQD

SEQ ID NO: 1149 - protein, 414 aa, Mesorhizobium sp.
GLMPASEKERKALADLDPYQLRAAGLDKALAPHELGRAIFHLHQRRGFKSNRKTDRKSDDRDKGKIATASAALAKKFEDENARTFGEFLWRRHRDPDMKRQAVLKAHDPAKGKPDLRAAKLRQPTRIRLEGQGATALYEFYPTREMLCHEFDALWEAQARHHPMLLTREAGDKIRSILFRQRELKPPLIGLCTFEYAAGEKESRLPKALPSVQAREIYERLGHIRLSTGSGTDRPLKSSERDDLATALLHCGLTKIKVSKTKGLAFKTEFRKALRLGGEVRINFEEMGEEGLVDLRTNRLLVQDDHYGPRWRALSWSGKDAFVKKLLEATDDDKLVARLMTEDGLSAVQARNAASIPLPDGYSRLGPTANAAILQALIDSRDENGFVVTYDKAVRRAGERLGKDWHHSDERDGE

SEQ ID NO: 1150 - protein, 369 aa, Neisseria meningitidis
GVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNT

SEQ ID NO: 1151 - protein, 379 aa, Geobacillus sp.
GVLTKEELDKLFEEKHEIDVWQLRVEALDRKLNNDELVRVLLHLAKRRGFKSNRQSERSNKENSTMLKHIEENRAILSGYRTVGEMIVKDPKFALHKRNKGENYTNTIARDDLEREIRLIFSKQREFGNMSCTEEFENEYIAIWASQRPVASKDDIEKKVGFCTFEPKEKRAPKATYTFQSFIAWEHINKLRLISPSGTRGLTDEERRLLYEQAFQKNKITYHDIRTLLHLPDDTYFKGIVYDWGESLKQNENIRFLELDAYHQIRKAIDKVYGKGKSSSFLPIDFDTFGYALTLFKDDADIRSYLRNEYEQNGKRIANLANKVYDNELIEELLNLSFTKFGHLSLKALRNILPYMEQGEVYSSACEKAGYTFTGPKKK

SEQ ID NO: 1152 - protein, 374 aa, Bacillus okhensis
DILNEAELQVLYQEKELLDIWTIRVEALDRRLSRTEWARLLIQLAQRRGYRSARKSEENDKETGVVLQNIRENKKLIDGYRTVGEMWVKDPRFQGRRHNSRSEYVFNVTREMLEEEIRTLFHTQRELGLSFASKEMEESYLSIWGKQLPFASGKDILKRVGFCTLEEQERRFPKATFTFQYFMVLDKLNRLRIKPSMRPLTEEERKSTLHYLFDRDDLSKKKTPPKVMYKEIRKQLNLAATETFNELTYDPNESMTKNENVLFVNLDAYYRIKQQCDLHNERYGPRDYDALGYALTVYKTDKDIRQYLRNKTNLANRIYSEELISNLLSQSYATFGHISKKALLAILPSMEKGDTFKVAADKMGYDTTGLQLVK

SEQ ID NO: 1153 - protein, 365 aa, Tistrella mobilis
GLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLS

SEQ ID NO: 1154 - protein, 371 aa, Kingella kingae
NVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQGQLNFSNFMELSLKALEKLLPLMEQGLRYDEACTQIYGNRHEKIAD

SEQ ID NO: 1155 - protein, 374 aa, Clostridium perfringens
NILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEG

SEQ ID NO: 1156 - protein, 375 aa, Neisseria sp.
GILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGRLRNKGGDYTHTFNRLDLQKELHLLFERQCALGNPFASAELQSKVDELLMTQRSALQGEAVLKMLGKCTFEPSEYKAAKNTYSAERFIWLTKLNNLRILYNGEDRALDEGERKQLLDEPYKKAKLTYKQVRSILNLPESAVFKGLRYGKDSDGLKAENGALMEMKAYHKIRTVLEKAGLKGEWENRIRNPEILDQIGTAFSVYKTDEDIKAELAALRLPENVLDALLAGLNFDKFIQLSLKALSNILPLMERGIRYDEACKEVYGDHRALAES

SEQ ID NO: 1157 - protein, 365 aa, Campylobacter coli
LKLNYQDYIANNGELPKAYEGRLISPYELRYKALNEKIEPKDLARVILHIAKHRGYMNKNEKKSSDNEKGKILSALKTNALKLEKYQSVGEYFYKEFFQKYRENTKDFINIRNKEGSYENCVLASDLEKELKLILEKQKEWGYSYNDNFIKEILKVAFFQRPLKDFSYLVGACTFFEDEKRACKNSYSAWEFVALTKIINELKSLEKESGELVSSQIINEILNHVLDKGSITYKKFREYIKLHESMKFKSLKYDKDNVESTKLIEFRKLVEFKKALGEHSLSREELDQIATYITLIKDNEKLKITLEKYSLNNEQIKNLLEIDFNDHINLSFKALNLILPLMKEGKRYDEACKLLNLKTKSNNQK

SEQ ID NO: 1158 - protein, 371 aa, Sulfurospirillum sp.
YKLIDKTLLDEEMGMFHSQSNRVDVWKLRHDALYHLLSGDELARVLIHIAKHRGYKFLGDDESDEESGKVKKAGAELKKKFLEAGCQSVGEWLWKERGLQGKKRNKSGDYEISIPRDFLVEEIQRIFETQQKFGSTFATSELQKAYTDIAFYVKPMQSIEDMVGYCTFYPKIKSKNQDGEKRAPKASPSAEQFVILSKIFSTIVIDENKQEKKLIELKSIEQLIQIARSKETLKYKQLRKELNLAKDISFKSISDEEKTWINLVGNAKFKKILGLNYETFLKNTEISDEIAKILTYDKTFEQKETKLKNLLVNIDWIDNNHIAELAKLSFSQFNQLSLKAIKIISKIMIEGYARYDEAVQYAFENNLLPKP

SEQ ID NO: 1159 - protein, 397 aa, Dechloromonas denitrificans
GLIADTKLFKPELPFSKSLWQLRVDGLDRRLNDEEWARVIYHLCKHRGFHWISRAEAKQAEGDSKSEGGKVKQGLAGTAKLMDEKGYRSAAEMVLAEFPQAQRNKQGEYQKALSRELLAKELALLFAQQREYGNLHTPGALETAILGNGDKKSGLFWQQKPALAGTDLLKMLGTCTFEKGEYRAPKASFTAERHVWLTRLNNLRIVTDGVTRQLTEQERQLCLPLPYRQAGDLTYKQLGSALAKAGLLEAGGFKFTGLAYPTEAQKAEGKAKDPESATLVKIPAWHELRQTLTKGGLNDEWEKLAGDALCGQPEIFDKIAWVLSVYKDDDEVRAELAKLALPNPQALTEALLNIRFDKFHSLSLKALRAIVPHMEQGLRYDEACVQAGYHHSQLLKV

SEQ ID NO: 1160 - protein, 402 aa, Nitratifractor salsuginis
GILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKS

SEQ ID NO: 1161 - protein, 386 aa, Enterococcus cecorum
GFIPSPNKNPYEIRVRGLEHQLSRDEIAIAVLHIAKRRGISYSLDDVVDENVTDFKGKIAKNQEALKNKTPGEIQYERLLKYGKVRGTVTNYVEYDEQPEYFLNVFPNSAYVDEAKRILTCQKQYYPEITDDLIENIVKIISRKRAYYIGPGNEKSRTDYGIYRTNGETLENIFEILIGKDSVNPDELRAPANSLTAQVYNLLNDLTNIRYNGSERLTPEQKQDILSELLTTEKTVQMLNVIAKKVNVKKEEISGFRTKKDDKPDFHTLEVYRKVRKHMLNKGIDINEWPTECFDELAFIFNLNTEIGEIRNRISEKVVPKYDFITNQIVDDLLEDPKIFAISTSQKWHRFSIKTMNVLIPELLNGYNEQMTILTRMGLLEDSKND

SEQ ID NO: 1162 - protein, 395 aa, Facklamia hominis
GFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNK

SEQ ID NO: 1163 - protein, 389 aa, Streptococcus sinensis
GLITDFSKVSINLNPYELRIKGLNEKLTNEELFIALKNIVKRRGISYLDDANEDGESSSSEYGKAVEENRKLLADKTPGQIQLERFEKYGQVRGDFTIEENGEKHRLLNVFSTSAYKKEAERILTKQQDYNQDITDEFIQAYLTILTGKRKYYHGPGNEKSRTDYGRFRTDGTTLDNIFGILIGKCTFYPEEYRAAKASYTAQEFNLLNDLNNLTVPTETKKLSEEQKRQIIEYAKGAKTLGAATLLKYIAKLVDGSVEDIKGYRIDKSEKPEMHTFDIYRKMQTLETVDVEKLSREVLDELAHILTLNTEREGIEEAIKVSFIKREFEQDQIAELVSFRKSNSSLFGKGWHNFSIKLMTELIPELYETSEEQMTILTRLGKQKTKARS

SEQ ID NO: 1164 - protein, 361 aa, Eubacterium dolichum
GIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELS

SEQ ID NO: 1165 - protein, 387 aa, Streptococcus macedonicus
GIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDYLSREVLDKLAGILTLNTEREGIEDAIKRNLPNQFTEEQISEIINVRKSQSTAFNKGWHSFSAKLMNELIPELYATSDEQMTILTRLEKFKVKKKS

SEQ ID NO: 1166 - protein, 377 aa, Turicibacter sp.
GFEKGEVLAPTPYHLRVKGLTEKLSKPEVYAALYNLMKHRGISYLEDVELDEADSSSVSQNVELLKEYYPCEIQLERYEEYGQIRGIIETYNKDGEKESLVNIFPTGAYKKEAEAIILKQGQFYPELDKVFLEKFTEILTVKRPYYVGPGNKKSRTDYGIYRENGETLENLFDILIGKCTIYPQEARAAKFSYTAQLFDFLNDMNNISIAGEKLTEVQKREIYHQIMSSKTVNMMKIITKVTGCLKEEVTGYRVDSKYKAEFHSFASYRQFRNKMLDYGFDVQTLNVEMFDKLAAKLTLNTEYHQIITQLESLNLGLSKELIEKIADFRKKNRSLFSKWHSLSLKAMNEVVDELWSTSKNQMQIFSELGGFKSNIEV

SEQ ID NO: 1167 - protein, 376 aa, Bacillus niameyensis
GLPSESIGKMDPYQARYNAIFGEVSKEELVAGLYHLVKRRGTTLDSPEDEKSSGNELSTKEQLSRNRKFLENRYICEVQLERLSNGHEKIRNHENRFRTEDYVKEARAILIRQQQRYSEITDEFIEDFINILKSKREYFDGPGSEKSPTPYGQYYLDKDGKLAYTSMINKMRGICTYFPDHLRIAKMSYTADLYNLLSGDLNKLLINGEYLTYEDKLYLIDHFIKKGKNITLTQILKYKGISDDSDVSGYRIDLKTDKPIFTEFTGFKELKKIVDKNDLPSSILEDIDLIDDIIEILTAEKSYYRREEQLKPLFSEYDQETIDRIVNAFKESTSFKGYHALSKKAIELILEDLWYTNKNQMELFAERKLEEKRLSD

SEQ ID NO: 1168 - protein, 364 aa, Massilibacterium senegalense
RIMAEDAQPISNKPYEIRVKGLSKELTDEELAIALIHIAKRRGIHNVETTLDEQKDDNELSTKEQISKNEKLLRNKFVCELQLQRLTRNKENEIPYKVRGYQNRFKTSDYIKEVQQILNTQRQYNKKITDEFIERYIELIKKRREYFEGPGEGSEYGWGGDPRKWYEQLMGKCSYFPEELRAVKASYSAQLFNALNDLNNIVIMREENTKLSAEEKRRLIEKVFKIRKKPTLKQIAKEVGVNFEDIKGYRVNAKGEPIFTSFDFYHSIKTITQRHEIIENDKILDQMARILTVMQTPSEKRERLKQEIPELTTSEISEISELRFTSTHSLSLKLIYLLLPELWSTTKNHMQILSEMKLKPKRIS

SEQ ID NO: 1169 - protein, 642 aa, Kurthia huakuii
TDFFGATDSLHFWKNDNQFEQRTLSQVLKELRINPKKIPTIYHLRKLLMEGPKQDIRLIYLAIHNLIKYRGHFLNTGRWTKQNQGFNFLVECSDIVTAYSEINGLALPSLDFQAIQSIIEDTDMVRKDKQKQLEKVSSKSFVPLWQLLLGLSVNAEKLFVESQNTILYKEAKLKLVLGSEELDEVRENLTEVENHFIDEAFALYQQIMLQDLLQGHECVAASKVASYEKYQEDLCEFKRLINETKDEALYRRLFITPKKAMAEYKEQPNKDNKEKLCLLDRYNRSSKDKEAVLNTMAKLLATSNVNHHADLIENIKEGTFLAHQKGTHNAAIPNQNSIYEIEQILTNQQSYYSFITDEFINKVIEIASFRIPYYIGPLAKNNQSKFAWLERINNEGHITPATFDSLVNESITAEQFIKRMINKCTYLQEEDVLPKQSLLYQYFEVLNELNSIQIRPANAASHTKYRLPIEAKKCVIEFGFRQYKVMTHKRLIQVLKEQQFEYLIGEDYEVFGTQQEGRFASSLKSYVEFKSLFKNSAVPFDEVMIEQLIEWLTIFNEKTIIKKKIKEQYPKFPDVMIERVLKKNFVGWGNLSKKLLDELILNDGKTVIEKMCDSTLNFREMLTVKNSNLEELIKKNNRSKRQ

SEQ ID NO: 1170 - protein, 622 aa, Streptococcus equinus
ESFFQRLEESFLTDDDKTFDSHPIFGNKAEEDAYHQEFPTIYHLRKHLADSPEQADLRLVYLALAHMIKFRGHFLIEGQLDAENTDVQKLFNDFVEVYDRTLDDSHLSEITVDASSILTEKFSKSRRLENLIKHYPTEKKNTLFGNLVALALGLQPNFKTSFKLSEDAKLQFSKDTYEEDLEELLGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMRAILRRQGEYYPFLKENQAKIEKILTFRIPYYVGPLARKNSRFAWAKYHSDEPITPWNFDEVVDKEKSAEKFITRMTLNDLYLPEEKVLPKHSHVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGHANRNFMQLINDDSLSFKTIIQEAQVIG

SEQ ID NO: 1171 - protein, 621 aa, Streptococcus equi
DGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIG

SEQ ID NO: 1172 - protein, 634 aa, Enterococcus faecium
EHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMIT

SEQ ID NO: 1173 - protein, 626 aa, Enterococcus italicus
NNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYK

SEQ ID NO: 1174 - protein, 637 aa, Streptococcus agalactiae
DSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGRSNRNFMQLINDDGLSFKSIISKAQAGS

SEQ ID NO: 1175 - protein, 626 aa, Streptococcus ratti
ESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSD

SEQ ID NO: 1176 - protein, 625 aa, Listeria monocytogenes
ANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAEAETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTT

SEQ ID NO: 1177 - protein, 644 aa, Lactobacillus sp.
PDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVKLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKQQAESGENVFAWMVRKNPSGNITPYNFDEKVDREASANTFIQRMKTTDTYLIDEDVLPKQSLLYQKYEVLNELNNVRINNEALSTDQKQRLIHEVFERHSSVTIKQVVDNLVAHGDFAQRPEIRGLADEKRFLSSLSTYHQLKEILHGAIDDSTKLHDIENIITWSTVFEDAAIFKTKLAEIDWLDPATIKKLSNIRYRGWGQFSRKLLDGLKLGNGHTVIQELMLSNHNLMQILADETLKETMTELNQDKL

SEQ ID NO: 1178 - protein, 646 aa, Pediococcus acidilactici
PTFLARLKESNRSNLDPKKSFQGSLLFPERKDYQFYEEYPTIYHLRKALMEEDRKFDIREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQTRPEFAALIQQANEKQFEGNDPNN

SEQ ID NO: 1179 - protein, 643 aa, Acidaminococcus sp.
PRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAK

SEQ ID NO: 1180 - protein, 662 aa, Lactobacillus sp.
PGFFVRLHQSWVSPLDKDRKKYQAIVFPTAKEDQAFYKHYATIYHLRDELMTQDRQFDLREIFLAIHHIVKYRGNFLQDTPVKDFEASKIEVGPILSHINNAFAEKIVEEQDPIELNVANATDIEAVIRGKDAEKTVYKMDKVKKIAKLLTDSTAKEEKNLAKQIANAIMGYKTQFETILGKEIDKSDKAQWEFKLTDGDADDKLDALLPDLDETDQTIIAEIKKLFSAITLSTIVDENKSLSQSMVAKYDKHHQDYKLLKAYIDTLQDRSIAKKLLLAYDLYVNNRHGRLLEAKKTFEDKKKKKALTKDEFYKIVKDNLDDSDLAHEIRQEIAADNFMPKQRTNSNGVIPFQLHQIELDKIIANQSQYYPFLAAENPVEDHRKQAPYKLDELVRFRVPYYVGPMITADQQKKTSGKSFAWMVRKEDGQITPWNFEQKVDRQESANKFIKRMTIKDTYLLGEDVLPANSLLYQRFEVLNELNNIRINGSRISVDLKQQIFNDLFEEKKTVTEKSLTSYLKQNLHLPTVEIKGLADPTKFNSSLASYYHLKSLHVFDKELADPQYQKDFEKIIEYSSIFEDKKIFQDKLHAEFKWLTPEQFKAISTWRLQGWGRLSRKLLVELHDTNGQNIMEQLWDSQKNFMQIVTEPDFKEAIAKENQNVT

SEQ ID NO: 1181 - protein, 659 aa, Treponema putidum
EDFFQRMEESPFYAEDKTILQENTLFNDRDFTDKTYHKAYPTINHLIKAWIENKVKPDPRLLYLACHNIIKKRGHFLFEGDFDSENQFDTSVQALFEYLREDMELDIDADSKKIKEILKDSALKNSDKQNRLNKLLGLKSSDKQKKALTNLISGNKANFADLYDNPDLKDAEKNSISFSKDDFDALSDELASVLGDSFELLLRAKAVYNCSVLSKVIGDEQYLSFAKVKIYEKHKNDLTKLKEVVKKYFPIEYRNIFGYKQSENNNCNYSRYVGVCKSGSKKKVINKTASQEDFYKFLKDILLKRSDVPEANGILTEIETGTFLPKQISKNNAEIPYQLRKIELEKILTNAEKFFSFLKQKDENGLSHSEKIIMLLTFKIPYYIGPINTSHKQYFPDRSWVIKKENAPQEKITPWNFFDHIDKEKTAEAFITSRTNFCTYLIGESVLPKNSLLYSEYTVLNEINNLQIIIDGKNICDVKLKQKIYEELFKKYKKVTQKQISTFIKHEGICNKTDEVIILGIDKECTSSLKSYIELKNIFGKQVDEISTKNMLEDIIRWATIYDEGEGKTILKTKIKAEYEKYYSDEQIKKILNLKLSGWGRLSRKFLESITSEIPGFIEPVNIITAMRETQNNLMELLSSKFKFNENIKKINSGFEDTD

SEQ ID NO: 1182 - protein, 356 aa, Environmental metagenome
GLLPSGERRTVLPALDAELRKRYPETETLPYFLRGRALDVKLEPFEIGRCLYHLAQRRGFQGRTAFADPEEKSGGKFGDEMKGLWNEICSSGARTLGEFLARQPAREVRLRGRHTHRLMYEQEFNLIWDAQKQHHPEILTPEHKALLFQALFFQRPLKSVTHLIGDCSLERGEKRAPCWTLQVQRFRVLSAVNNLRVVEPSGKIRPLEPQERELLAAESLRREQLKFSTIRRILKLDKDCRFTVEEGGEDCIPGNATSARIYKVMGDEWLKWPQDRQEALVAILGDTSRYPTDDDLVKELVTALGLPPENATRLCAVALPTGYASISLNAIAKVTPRLEKGMTFAEARRILWPEDF

SEQ ID NO: 1183 - protein, 534 aa, Environmental metagenome
GCLPEDFTPQNAGRKFKELIEKPDELKNLPDDWYVYMLRSKALKEPVTQIEFGRILYHLNQRRGYKDIGELMEEIEEKDDTKQGKKYDKWIEQVTIYSVEKKSDLKNKKQEYWVILDDGREGTSIIANIESLTGKEIELEIRRRVKKNSEETFEFALPNRNDWQNKLDALDKQISQSGMHVGEFFWNKIKEDRYFRIRQNFVHREKYIEEFDAIWEKQQEFIPALIDETVKQDVIQRIVRNEKERQKWAKKPLKEFIKNYIIYYQRPLKSQKSKKANCRFEPMIKVINQSTGESLSIENKCMPLSSPLYEEFRIWQKLNNLRYKDINNKNYELTNEQKEALFEKLNNGQTLKESSIFKILGLDKNLYSDFNFDQIEGHTVKSKIASVLKDYDSGKIIGNEEFLYKVWHLLYSVNETEYRKNTLIKWFNLTEEDAKRLAKVRFEKKTGSLSSRAVKKLLPLMRAGKYFDEQSLHDSILFRINNIINGEFDPDVTDDIREFFKEYKSIRDFSGMPYWKAATLVYGSHSTGFSDTRY

SEQ ID NO: 1184 - protein, 373 aa, Environmental metagenome
GLIKNIKDLFYNNKITDVWELRALALNEPLSPEDFSRILIHIAKHRGYMMSVDSDDDEIDGDKDGKKDDKKKIKKAIAETERAIKELNYRTYGEYVYKSALDSKKPMRNRGGEYRYFPSNNLLKKEIDIIFKKQFELGNKFATEELKNKYWEIASSIKDSKSFEDMVGACTFFKDEKRAPKNCYSAEKFVLLTSILNTVVIDEDLKEIKIINIKHIDEIINFAENEDGGISYKKLRKFLSIPDTAMFKGISYEKKKKAKGKKETDPEDKVFVNMYGLNALKKICGEKIAKDKGLSLKIMRVLTYFKGVEQRRSKLLEIEELNADMASQLAKLENIKEFVSLSAKAIEILLPYMESGLRYDEAVKTARIDGKIP

SEQ ID NO: 1185 - protein, 639 aa, Eubacterium sp.
CTFFRRLHESDLWPEDKSGDDKYAVFADENYTDKDFHKEYPTIYHLRYELIKNKEPHDVKLVFLALHHIIKNRGHFLFDSLSSAEDFNSAYETMCSYLSDNEIQLNCSDIEQFKAILKDRRQGKIEKTKNLASLFGITKKSDPVSYAVMAVLSGSTVKMCDLFGDDELKTVEKNNISFASGYEENEEIYASVLGDRFELVKILKAVYDWAVLADILDGKKYISEAKVAVYEKHKNDLKTLKKYVKTYLPEKYNEIFKISDGKKDNYVAYSGHIKESGKTGELKKTCNSENFCAYLKKTLGKNADLSYKEMFDEIENKTFMPKQVTKSNGVVPMQVNEEELKAILDNAKDYLSFLNSCDENGVSVYDKIIKIFEYRIPYYVGPLNTHTENSWLKRKDGVKIYPWNFDDVVDIDSSAEKFINNLTSKCTYLPECDVIPKCSLLYSKFTVLNEINNLKLNGEDIPVELKQGIYKDLFMTRRKVTVKQIKDYLKARGCYDNNDVLSGIDTTVKSSLKSYFDFKGFESLTFDDKESIIASSVIFGDDKKLLKKRLKKLFPEKLTDEDIKKICKLKYTGWSRLSKEFLCDVEFTYKKTGEVMNVITALWETNYNLMQILYSEDFCCDGDEKKNLNDKLDELSYTG

SEQ ID NO: 1186 - protein, 370 aa, Environmental metagenome
ELIQAQEIKSAFETVLGQPSPWELRAEGLDRLLTGQEFARALFHIIKRRGFKSNRKAAKSSEDGKMIAGIEANRERMREKGFRTAGEMYWSDPFFDLRKRNTTDSYINTVDRGLLEEEIKTLFKRQRELGSVFTKHEFENAILEVFSWQKPYVSGDDIIRMVGTCTFEPNELRAPRYSYHAERFLLLQKINSTTYSTNGDKERFTPEQRKVIEGLAYKNVRVTYAQIRKALDLPEEARFAGLTYLRRPEKKAELVESLECENTVFFELKGYHSIQNACSVDGMWDRVKQNPELMDNLATALTFYKTDEDIEEWLTERGVEKEIINAVSGCEFTKTANLSLVAIKKILPHLEEGLHYSEACAKAGYNHTGL

SEQ ID NO: 1187 - protein, 395 aa, Environmental metagenome
GLMPADTAARKELEKLDPYWLRARALAEPLTLHEIGRALFHLNQRRGFSSNRITDADDAEGGAMKQGMAQLQEALEQAGARTLGEFLAKRHRRDREGYRVDPSGQRISKANGNDREASKGVRFRPHAEGSKLLYDFYPTRDMVAHELRQVWVEQAKTHTELTEPLREQLEHVIIAQRPLKKPRVGRCTFRPDEERAPRALPLFQRFRILSELAALEIERPGRPARKLTIPERDLLANLLGSQTSPVSFTKMAKALKLPDDADFNLARGGRKGLDPDKTAAILAKTGKGESFGKGWRSIPFDRQSEIVQRLLNEPDEDALISFLIEECDLSDEQAQAASSARLPQGHGHIGPSMLEELVDVLQNDSVEVVDPQTGEILPRPLTYDQAVVRLGSHHS

SEQ ID NO: 1188 - protein, 382 aa, Environmental metagenome
GLLPAFGTSQWDRLMRLDPYDLRSRGLTEALEPEEFGRAIYHLAQRRHFRGRDIESESEDDNADSEELAARAEAKDMLATLRQSGMTLGQWLNQIESGKRKRGIHAARSTVEDEFERLWAAQEAHNDKLKDPEFQSSIRKIIFYQRPVFWRQNTLGSCPLIPGAELCPKGSWLSMQRRMLEKLNNLELVGAGARKLDPEERMAILESLQSQASMSWAGVRKALSSIYRNRNLTGEEKRLKFNLEIGGEKGLIGNPLEQRIAAIVGKSWSAHPHKQKIREALHERLWKADYRKIGTQRVVIQPQKKRRLDRLNAAESIVKEFELPGDLIQPISEISFPSGWEPYSIDALLRIIPELENGTRFGELLVGPELEDWRTKTFPDRI

SEQ ID NO: 1189 - protein, 436 aa, Bifidobacterium bombi
PVEDESQFPAGSNPYIAWQVRAKLAETFIPDVETRKRMISIAIRHIARHRGWRNPYSSVADAERMSHTPSPFMVEYAKKLDFEINDRRTNGFYHSPWQSVDEEGKRLSKSELEKQPKIEDWNDNPINGKTIAQLVVSSLEPQTKIRRDLTHGLQTESTLNIQTEKLHQSDYIHELETIFERQHVDQTTQEQLLEATFHTKNPKAVGAAAKLVGKDALDSRYYRASRATPAFEEYRVMAAIDTLRIREHGTERQLTTDERRKLFDFIKGLPSKKTKNEPSISSLTWGDVADFLGIQRIDLRGLGSLKDGEPVSAKQPPVIETNDIMQKAPDPIAAWWSQANTKERDRFVEFMSNAGAIKDTSDEVRNIDAEISQLLEELTGSELESLDKITLTSGRAAYSSQTLRNITNYMYETGCDLTTARQELYHVGKNWAPPAP

SEQ ID NO: 1190 - protein, 367 aa, Environmental metagenome
KVVTANELNNLFIGNKKQKDVWDLRREALYRELNNKEFARIMVHLAKHRGYASNRKSEEPTDSEGKAVLSGITHNKTILQEKSYLTIGEYISTKTKKRNGKDTEGKLNYENSVSREMLINEITTIFERQKEFSNPHAKEELLEEYKNIAFTQRALKSVEGMVANCPFETNKKRAPKASSTFETFRALQKLKNLRMISNEGESALTKEQILQAIQKAKTAKSFTYKTLKTLFALPKEVQFKGLTYFDHKTGEAKEPESAKLLDFSAYQKIKDAIQSSDNLYWNKIEESVNLLDEIAKILSTHKDDKKSLEELNKIIDNPSVCNALISLSFSGFGHISVEAMRKINPYLLEGIDYDKACEMAGYDFKAI

SEQ ID NO: 1191 - protein, 382 aa, Corynebacterium camporealensis
ETKPFEDYSDPYIPWNARVALVNGYIEDDQQRGEYLSIALRHIANHRGWRNPYWKTRSLYSPEGPSDAFETIRKDLEKRAGRPVPKDITVGQLITFARIGTDRIRGEAQNKKTGHNNPAILSARLHQLDHAREINEIAKVQKLDDDLRKHIIDLVFAAESPKGAQLGRVGKDPLQPGKDRALKATDAFQRYRIAALTGNLRIRGTQGNDRLTREQRQLIFDHLVNLPHTEEPSWLNIAEILGIDRGDLLGTATMTDDGERAGSKPPVHDTNRAILSSKVKPLVHWWKAANFDEQKAMLKSLSNAEVDDFDSPAGASVQAFFADLDEKQHDKLDSLHLPMGRAAYSEDTLVRLTERMLNNNQDLYEARLAEFNIAKDWTPPKP

SEQ ID NO: 1192 - protein, 487 aa, Environmental metagenome
GFFPATAAERKALETLNPYALRAKGLDKALTPAEFARALFHINQRRGFKSNRKTDKKENDSGALKTAIQKLRESLQGENCRTVGEWLNKRDNSGQTVRARYRQEKHIKEDGKSKIDKYYDLYIDRAMIEHEFDELWSKQAELDPARFNETARAELKDILLHQRPLKPVKPGRCTFLPEEERAPLALPSTQRFRMYQEVNNLRILRDGLKEEPLTLEQRDTLIFALEENNKCSFTRIKKLLGLSGAVQFNFEDPKRQELKGNTTSAILGKKDLFGPDWFKFDETKQDAIVMKLLTEESEETLVRWLQNETGVDEKTAEAIANAGLPEGYGSLSAQALARILPELRRDVVTYDKAVKAAGFEHHSKLGSDTEIPSITFKTERIDLDTGEIKAFHIHDKLPYYGEYLQRHVGFGSGKPEDTPEKRYGKITNPTVHIGLNQVRLVVNALIQRYGHPSEVIVEVARELKQNHEQRKEESKRQAENQDRNKRL

SEQ ID NO: 1193 - protein, 368 aa, Environmental metagenome
GLLPTDDPKQWPAELAQADPYDLRDRGLSQKLSPHEVGRALFHILKRRGFQSARIAAVEPSDPAKEKEDEGIKAEISQIAAELQGRTLGQWLKSQSKRRGHHTARTMTQEEFERFWTAQVKYHPDLLTDNLRAALAETAFRQRPIFWRLKTLGTCLLEKDAPLCPKGAWIGQRFEMLQTLNNLRLAGGNARPLDEDERRLLLAALETSPSLSFPAARKLLKPVWQRNGTSLKTKFNFEVEGGKKALPGNALEAALIDAFGEAWNTHPKKDAIRAELQDRLWAIQYRKLGEKRVEIRDGNSAEAERQRFIAFAQAEWNASRKTAETLSRIEPPAAWLRHSIKAIQKLLPHMEAGLTYAEARKLVYPEQF

SEQ ID NO: 1194 - protein, 540 aa, Legionella pneumophila
RDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVR

SEQ ID NO: 1195 - protein, 372 aa, Environmental metagenome
GLLPPEIAADDAKPEIILNALGDPYELRTKALDEPLQPYELGRVLLHLCARRGFLSNRKAHLVAYLAEEFSDYLAQIDDTDDAANSSASTEDLGKVKDGIKKLSEEIHVSGCRTLGEYLYRLDRHTRKRARFTSRQMYLDEFEMIWESQARYNPILTDDLKIQVHQVIFFQRPLKSQKSLVGKCLLEPGRKRTAKARLEAQQFRIWQDINHIEIQNPETRAWRRLTQEERQKLFHALHEKKSLSWSGVRKLLGIHRGERINLEEAKDKLIGNLTWIELSEALGDRWSRMSDTERQSLVEDLLTISDLTARARRLREHWKLSREEQYLLCTWEPQPGYTNHSLKAIRAMLPYLERGAIYSEARQAAGYKYEVL

SEQ ID NO: 1196 - protein, 558 aa, Environmental metagenome
NWITDHTVLTENGNKSTFETFKLRSEAAERALELNELARVLLHINKKRGYKSSRKVNNTEEGQLIDGMDIAKKLYHENITPGEFVLELLKSGKKKIPDFYRSDLNNEFEKIWNNQAKYHPDIFTNSLKDELKGKGKQATWAILKDPLKLVGVKRDKKRDEIKLENYQWRVDALTQQLNFEQIAVVLQEINGQINNSSGYLGAISDRSKELYFNNQTVGQYLYSQLKANPHTRLKNQVFYRQDYMDEFEKIWEVQSKGREHIFTDTLKCEIRDVIIFYQRKLKSQKGLISFCEFEQKEISVGDKKKIVGLRVAPKSSPLFQEFKIWQNLHNVKIKNKNTKEVLVLNQDEKNCLFSELNVKGKLTANQVLKLIKGNPKDWEINYTELDGNRTNQALFDAYLSILEIEGYDVREELKLKLNKDDITLADIDKPAAEIMHMVETIFKHLKIDTNILHFNPLIEGNSFEKQASYQLWHLLYSYEEDNSPTGMETLYRLLGEKFGFNKEQAKIIANVSFQDDYGSLSSKAIRKIFPYIKESDFSTSCELAGYNHSKNSLTKEEI

SEQ ID NO: 1197 - protein, 424 aa, Environmental metagenome
DMAPQGDFKDQAYWLSPEFLKWVALNPYELRHRAITEKIALKELGRVFYHLAQHRGFQSNARNVSDNDDSTIYKGGNGMTGIDTTASLIENETLGSALYQKLFPAPGQPFKYFPERIRRRYTTRKMYIDEFEKIWEEQSRFHPELTQQLNEEIGGRRREGYKRDGVLFFQRPLRSQKSKIGKCTFHPNKSRRAISAPDFEEFRIWQFINSIRCNGESLVDADRQLVYNLLVSQDRVKFDKLRKHLGKASAAYSFNFDDETSCPNAPTLRFLSSRGIFSQSWFGFKKSKQEEIWHDLYFYDDKELLRKRAQEKWGLSEDAATKFGDYSLKQGFASLSRRAIQNILPFLALGHDYDVAVTLGGIKNALGDQNIVDIYDTDFRIAVEEIVRTNPRGGYINHLKAWLKDNYGFEDKRLEKLYHHSADV

SEQ ID NO: 1198 - protein, 638 aa, Acidaminococcus_intestini_RyC-MR95
ISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEI

SEQ ID NO: 1199 - protein, 675 aa, Coriobacterium_glomerans_PW2
MEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKV

SEQ ID NO: 1200 - protein, 673 aa, Eggerthella_sp._YY7918
MAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKI

SEQ ID NO: 1201 - protein, 647 aa, Finegoldia_magna_ATCC_29328
IKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYI

SEQ ID NO: 1202 - protein, 640 aa, Lactobacillus_rhamnosus_LOCK900
ITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTT

SEQ ID NO: 1203 - protein, 451 aa, Mycoplasma_gallisepticum_CA06
NSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNL

SEQ ID NO: 1204 - protein, 618 aa, Streptococcus_agalactiae_NEM316
MSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPII

SEQ ID NO: 1205 - protein, 619 aa, Streptococcus_dysgalactiae_subsp._equisimilis_AC-2713
MSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAI

SEQ ID NO: 1206 - protein, 619 aa, Streptococcus_gallolyticus_subsp._gallolyticus_ATCC_43143
AKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQII

SEQ ID NO: 1207 - protein, 386 aa, Streptococcus_gordonii_str._Challis_substr._CH1
GLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKE

SEQ ID NO: 1208 - protein, 620 aa, Streptococcus_mutans_GS-5]
MGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEI

SEQ ID NO: 1209 - protein, 393 aa, Streptococcus_salivarius_JIM8777
GLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTS

SEQ ID NO: 1210 - protein, 386 aa, Streptococcus_suis_D9
HINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSS

SEQ ID NO: 1211 - protein, 387 aa, Streptococcus_thermophilus_LMG_18311
GLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTS

SEQ ID NO: 1212 - protein, 653 aa, Treponema_denticola_ATCC_35405
IAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENI

SEQ ID NO: 1213 - protein, 614 aa, Lactobacillus animalis KCTC 3501
LAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETI

SEQ ID NO: 1214 - protein, 661 aa, Lactobacillus ceti DSM 22408
LAKVDPQFLLRLKESQYHMEDKSTDDKYVLFNDQNRTDGEFFTEYPTIYHLRSELMQGKKEDIRAVYLALHHIVKYRGHFLLPGDNYDMQGNLSELIKRLFKFIEETLFIEDLGLTDEIQSKIEEILLTKTKTRLDRQKEIVKLFNTKHQKLDDKQKKLLEAIFKLCLGLKGNMVNIFGDKGEYGIDFTDVEDKKKKVEFSADYDNNINDYVDFFGEYFELLEITKKINDTVIFSEILVDGKGFSESKVISYEKHQQDLRKLKTLLKSLDKTLGYKYGEGLYQKILLDDVKSNYVNYSGNSQKLKKCTKDEFYGFIKSKLNSVTKKEKVSEAQQKEIAQILADMEFGDYLPLQRTTDNGVIPNQLHKKELIEIIEQQTKYHDFFNDVDENGLTIKDKIISLMTFRIPYYVGPLNDYHKVADGTGHAWIEKKKDGKIYPWNFDEMVDTEATAEKFIKNLTNKCTYLKGEDVLPKESKLYSEFMLLNELNNIKIDNQKLDPKLKMKMVSELFMKKNEKITKKKIVDYLRSIGQANGNEMVSGIDREIKSDLKTIHKIQHYYQDASLEMAENIIRWNTIFNDSTSDILKDKITKAYGDVLTPGQIKGLSNLACKDWGKLSEKFLTGIRCDVGEFKNISIIQAMRDTNNNLMELLSNKYEFMDKI

SEQ ID NO: 1215 - protein, 644 aa, Tissierellia bacterium KA00581
ISKIDNTFFKRLKESNLYNEDKSIKFNYPLFNDKDYTDIDFYNEYKTIYHLRKDLIFEDKKFDIRLVFIALHHILKYRGHFIFEGQSFEEIKSFDSIFTQLSSYFLENFDFNIDVSIKEKLEEIILSDNTKSIKKTEFKKIFSDNKVLSVLNMAIGSKVSLKDVFNNEELKEQKISFSEIDYENEKRDEFYQLLGEDIFLIDLAKKIYDFMVLKKILKNTDSFSASKVALYCEHKKDLDDLKYIFKKYLTKEDYFKFFRSNVEKINYPSYIGLNKIKSKKIIKENKCSISDINKELKNKYLKDIKLEAKDKELFNRIFNKLDEFKFLEKLKSSENSTVPYQVHEIELKKILDNQRKYYPFLNEKIDGKSVYEKIIQLFEFKIPYYIGPLNTDPNVKGKNTWVVRKDENNKTPITPWNFEQKVDMQKSAEEFIKRMTNRCTYLKAEDVIAKNSLLYEEFILLNELNKVTVDNEILHPTLKTEIINELFKTTVKVTKKKFIEFLKKKQAVNDVESITGIGVEFNCKLQGYNTFRKILGKKIENVNVKNFVEKCIELKCLYGSDKKLFENAIGKIYREYNITDEEFNKINRLNFNKWARLSKKFLTEISFEKTDGTKRFESVIEALRSTNYNLMELLSDKFNLQSKI

SEQ ID NO: 1216 - protein, 653 aa, Veillonella parvula ATCC 17745
MAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERI

SEQ ID NO: 1217 - protein, 518 aa, Environmental metagenome
GMCPLTNEQLMIWKHWDKNKKSEGRHFPHTKEFIEWLRLNPYELRYKGINGELTKMEFGRFLYHIIQRRGFLSTRKEKETGKIYAGKENMVGIDDTKTELNGNTLGEYLYTIYPEENESYKNIQNEEGEDVRIRGRYTLRDMYVEEFEKIWQNQASRLGLDKVSVIKQKVVFLNGSKDRNRNAKKIKYLKNNRDKIEVQEIIVEREKANKTLTRVTSYENIPLHDHLGGNIEISDDKIKFDNKDSVLFYQRPLRSQKSLLGKCRYEKNKTPVSVSHPDYELFRAWQYVNTIKFGNNIPLPIEQKSAIVEFLRTKKTSVKFADIVKLLNMSHENFNYNYDDKVEGCPSIAQLSKLFSNEGWENNYHNIWHDFYFFDDSEKLFKKLANTKEYKMKNVIKIDDIKKVSIKDDKYASLSLKAVRNILPFLQRGLMYNQAVFLGGVMNAFNYKALSDEIARWDRFADYHDTIIKDILSIIKERNKEGEAIQKVKEYLSDPANHYGFEKESPAFKKLYHHSQEI

SEQ ID NO: 1218 - protein, 631 aa, Enterococcus faecalis OG1RF
MTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAI

SEQ ID NO: 1219 - protein, 386 aa, Streptococcus gallolyticus
DLINKEQIPTSNNPYQIRVKGLSEILSKDELAIALLHLAKRRGIHNINVSSEDEDASNELSTKEQINRNNKLLKDKYVCEVQLQRLKEGQIRGEKNRFKTTDILKEIDQLLKVQKDYHNLDIDFINQYKEIVETRREYFEGPGQGSPFGWNGDLKKWYEMLMGHCTYFPQELRSVKYAYSADLFNALNDLNNLIIQRDNSEKLEYHEKYHIIENVFKQKKKPTLKQIAKEIGVNPEDIKGYRITKSGTPQFTEFKLYHDLKSIVFDKSILENEAILDQIAEILTIYQDEQSIKEELNKLPEILNEQDKAEIAKLIGYNGTHRLSLKCIHLINEELWQTSRNQMEIFNYLNIKPNKVDLSEQNKIPKDMVNDFILSPVVKRTFIQSI

SEQ ID NO: 1220 - protein, 356 aa, Staphylococcus pasteuri
EIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKL

SEQ ID NO: 1221 - protein, 58 aa, Prevotella histicola
MKKILGLDLGTTSIGWALVYESENADEKSSIVRLGVRVNPLSVDEKGNFEKGKSITTN

SEQ ID NO: 1222 - protein, 59 aa, Chryseobacterium gallinarum
MVERILGLDLGVSSIGWALVEEDVKNPENNKIIKLGVRVNPLTIDEKTNFEKGKSITTN

SEQ ID NO: 1223 - protein, 58 aa, Parabacteroides sp.
MKRILGLDLGTNSIGWALVNEAETDEEVSSIIRLGVRVNPLTVDETQNFEKGKSITTN

SEQ ID NO: 1224 - protein, 58 aa, Capnocytophaga canis
MKHILGLDLGTNSIGWAYVKEAENDTETSEIVDLGVRVNPLTTDEKTNFEKGKPISTN

SEQ ID NO: 1225 - protein, 59 aa, Ornithobacterium rhinotracheale
MNTILGLDLGTNSIGWALIKVLNDKTRLPLEIIDLGVVVIPTDQRTLDKFSKGESISKT

SEQ ID NO: 1226 - protein, 58 aa, Weeksella virosa
MKTILGLDLGTNSIGWALVEQDFENKQGLILGMGSRIIPMDAGIIGKFAEGSSISQTA

SEQ ID NO: 1227 - protein, 58 aa, Flavobacterium frigidarium
MKKILGLDLGTTSIGWSFINESENENETSSIVNTGVRIVPLTSDEEADFKKGNTISIN

SEQ ID NO: 1228 - protein, 41 aa, Rikenellaceae sp.
MEKRLGIDVGTNSLGWAIVEVDDEGCTLLDRGVDIFQEGVA

SEQ ID NO: 1229 - protein, 47 aa, Jejuia pallidilutea
MSKLGLDLGSSSVGWAKNVGGKIVKSGVITFNTGMSKGQSGGYVSPT

SEQ ID NO: 1230 - protein, 44 aa, Caenispirillum salinarum
MPVLSPLSPNAAQGRRRWSLALDIGEGSIGWAVAEVDAEGRVLQ

SEQ ID NO: 1231 - protein, 40 aa, Salinispira pacifica
MPYTLGLDLGSSSLGWALVDEEQQNIIKTGVRVFPGAATD

SEQ ID NO: 1232 - protein, 40 aa, Sulfitobacter donghicola
MRLGLDIGSTSIGWWIYETTDGQITSVIDGGVRIFSDGRD

SEQ ID NO: 1233 - protein, 48 aa, Mucispirillum schaedleri
MAEKKFKYRLGLDLGTNSIGWCMLRLNKDNEPAAVIKSGVRIFHDGRN

SEQ ID NO: 1234 - protein, 51 aa, Mesorhizobium sp.
MGTRYSFDIGTNSIGWAVWRTGRDPKGIFGEKDAPLELLGAGVRLFKDGRN

SEQ ID NO: 1235 - protein, 51 aa, Neisseria meningitidis
MAAFKPNPINYILGLDIGIASVGWAMVEIDEEENPIRLIDLGVRVFERAEV

SEQ ID NO: 1236 - protein, 39 aa, Geobacillus sp.
MRYKIGLDIGITSVGWAVINLDIPRIEDLGVRIFDRAEN

SEQ ID NO: 1237 - protein, 50 aa, Bacillus okhensis
MTDTRDYRIGLDIGTNSIGWAIIELEYNGEQYDKKGLIDAGVRMFDKAEI

SEQ ID NO: 1238 - protein, 47 aa, Tistrella mobilis
MINERLTFGIDLGIGSCGWAVLRHADAAGEPGVIEGLGSWCFDVPET

SEQ ID NO: 1239 - protein, 48 aa, Kingella kingae
MAAKSLNYILGLDLGIASCGWAVVEMDEQENPLRLIDVGVRTFEEAEN

SEQ ID NO: 1240 - protein, 43 aa, Clostridium perfringens
MNKDINYALGLDIGITSVGWAVINLDLNRIEDLGVRIFNAAEN

SEQ ID NO: 1241 - protein, 48 aa, Neisseria sp.
MKKQPQRYILGLDLGIASVGWALILVDGAENPVGLLDCGVRTFERAEV

SEQ ID NO: 1242 - protein, 36 aa, Campylobacter coli
MKILGFDIGINSIGWAFVEDNQLQDCGVRLFTKAED

SEQ ID NO: 1243 - protein, 45 aa, Sulfurospirillum sp.
MVEKILGIDLGISSLGWAVVEYDKDNDENNKIIDCGVRLFTAAET

SEQ ID NO: 1244 - protein, 39 aa, Dechloromonas denitrificans
MSATYTIGLDIGIASVGWCAFGETHILDLGVRAFDKAET

SEQ ID NO: 1245 - protein, 46 aa, Nitratifractor salsuginis
MEDRIVKKILGVDLGITSFGYAILQETGKDLYRCLDNSVVMRNNPY

SEQ ID NO: 1246 - protein, 42 aa, Enterococcus cecorum
MKYIESVSIGFDIGVGSVGYAVINSKTKQILESGVSIFPAAV

SEQ ID NO: 1247 - protein, 37 aa, Facklamia hominis
MYSVGLDIGIASCGYSIINDVNGNIVELGTLLFKSRN

SEQ ID NO: 1248 - protein, 39 aa, Streptococcus sinensis
MNGKILGLDIGVASVGVGILDKKTGEIIHASSRIFPAAT

SEQ ID NO: 1249 - protein, 39 aa, Eubacterium dolichum
MGRLVLGLDIGITSVGFGIIDLDESEIVDYGVRLFKEGT

SEQ ID NO: 1250 - protein, 40 aa, Streptococcus macedonicus
MTNGKILGLDIGIASVGVGIIEAKTGKVVHANSRLFSAAN

SEQ ID NO: 1251 - protein, 38 aa, Turicibacter sp.
MGYTLGLDIGIASVGFGLIDNVDGKILESGVRLFSSAD

SEQ ID NO: 1252 - protein, 41 aa, Bacillus niameyensis
MEKLRRVLGLDIGVSSVGWGIIDQDSGDVIDAGVRLFEEAA

SEQ ID NO: 1253 - protein, 40 aa, Massilibacterium senegalense
MLENYILGLDIGIGSVGYGLIDENQNIIDAGVRLFPEADV

SEQ ID NO: 1254 - protein, 44 aa, Kurthia huakuii
MNYSIGLDIGTTSVGWACINEQHEILRYQNKWAIGVREFEAAQT

SEQ ID NO: 1255 - protein, 59 aa, Streptococcus equinus
MEKSYSIGLDIGTNSVGWSVITDDYKVPAKKMKVLGNTDKKYIKKNLLGALLFDSGETA

SEQ ID NO: 1256 - protein, 59 aa, Streptococcus equi
MKKPYTIALDIGTNSVGWVVVTDDYRVPTKKMKVLGNTERKTIKKNLIGALLFDSGDTA

SEQ ID NO: 1257 - protein, 59 aa, Enterococcus faecium
MKKEYTIGLDIGTNSVGWSVLTDDYRLVSKKMKVAGNTEKSSTKKNFWGVRLFDEGQTA

SEQ ID NO: 1258 - protein, 59 aa, Enterococcus italicus
MKNDYTIGLDIGTNSVGYSVVTDDYKVISKKMNVFGNTEKKSIKKNFWGVRLFESGQTA

SEQ ID NO: 1259 - protein, 59 aa, Streptococcus agalactiae
MNKPYSIGLDIGTNSVGWSIITDDYKVPAKKMRVLGNTDKEYIKKNLIGALLFDGGNTA

SEQ ID NO: 1260 - protein, 59 aa, Streptococcus ratti
MKKPYSIGLDIGTNSVGWAVITDDYKVPAKKMKVLGNTDKNYIKKNLLGALLFDSGNTA

SEQ ID NO: 1261 - protein, 76 aa, Listeria monocytogenes
MQLKIIEGMKKMKKPYTIGLDIGTNSVGWAVLTDQYDLVKRKMKIAGDSEKKQIKKNFWGVRLFDEGQTAADRRMT

SEQ ID NO: 1262 - protein, 50 aa, Lactobacillus sp.
MTKLNQPYGIGLDIGSNSIGFAVVDANSHLLRLKGETAIGARLFREGQSA

SEQ ID NO: 1263 - protein, 48 aa, Pediococcus acidilactici
MGDRKYNLGLDIGTSSIGFAAVDENNQPIRVKGKTAIGVRLFEEGKTA

SEQ ID NO: 1264 - protein, 47 aa, Acidaminococcus sp.
MGKMYYLGLDIGTNSVGYAVTDPSYHLLKFKGEPMWGAHVFAAGNQS

SEQ ID NO: 1265 - protein, 50 aa, Lactobacillus sp.
MTKRIDDYILGLDIGTNSCGWAVTDKKNNLLKLRGKTAIGSHLFDEGHTA

SEQ ID NO: 1266 - protein, 50 aa, Treponema putidum
MKKEIKDYFLGLDVGTGSVGWAVTDTDYKLLKANHKDLWGMRCFETAETA

SEQ ID NO: 1267 - protein, 58 aa, Environmental metagenome
MIYSANSMAQVEGDVKNRMRKYILGIDLGVNSLGAALIDSENQAIVWTGVRIFSGPFE

SEQ ID NO: 1268 - protein, 44 aa, Environmental metagenome
MSTKKIVGFDLGTNSVGWAVVENSDENAAKIAGAGSRILPLDPK

SEQ ID NO: 1269 - protein, 42 aa, Environmental metagenome
MKTLGLDLGIKSVGWALIESDENRENYRILDLGIRLFSSGQA

SEQ ID NO: 1270 - protein, 53 aa, Eubacterium sp.
MGNKLRNVDDYYLGLDIGTESVGWAVTDKYYVIPKFKGNAMWGVHLFDEGETS

SEQ ID NO: 1271 - protein, 39 aa, Environmental metagenome
MKYSLGLDIGITSVGWAVLNLDKKRVEALGVRGFNAAED

SEQ ID NO: 1272 - protein, 43 aa, Environmental metagenome
MTVRYRLGLDLGTNSIGWAAVALDAEGRPGRLLDGGVRIITPN

SEQ ID NO: 1273 - protein, 43 aa, Environmental metagenome
MALIFAFDIGTTSIGSAVINHDPGRKIGKILRLGVRIFPETRE

SEQ ID NO: 1274 - protein, 49 aa, Bifidobacterium bombi
MSQHRRYRIGIDVGLNSVGLAAVEIDANHDNPLDEIPISILNAQSVIHD

SEQ ID NO: 1275 - protein, 45 aa, Environmental metagenome
MSKMILGLDLGITSIGWALVNVDDEDAQNNKIIDSGVRIFTIAEH

SEQ ID NO: 1276 - protein, 41 aa, Corynebacterium camporealensis
MQKNYRVGIDVGTHSIGFAAIEVDDHDRPIHILSAMSLIHD

SEQ ID NO: 1277 - protein, 47 aa, Environmental metagenome
MFGKMRYRLALDLGSTSLGWAMVRLDKENQPCAVIKAGARIFSDGRN

SEQ ID NO: 1278 - protein, 42 aa, Environmental metagenome
MRIWGFDVGTTSIGFAVIDYDSDRKAGRIERLGVRIFPEGVT

SEQ ID NO: 1279 - protein, 52 aa, Legionella pneumophila
MESSQILSPIGIDLGGKFTGVCLSHLEAFAELPNHANTKYSVILIDHNNFQL

SEQ ID NO: 1280 - protein, 41 aa, Environmental metagenome
MLGLDIGTNSIGWALIDTDPTTGRAVGIRDCGVRIFQEAVD

SEQ ID NO: 1281 - protein, 44 aa, Environmental metagenome
MKKILGLDLGTNSIGWAYVNEAENTNEQSSIIKLGVRVIPLTTD

SEQ ID NO: 1282 - protein, 45 aa, Environmental metagenome
MDSKKILGLDLGTNSIGWSLVEINREENQGRILGMGVRIFPEGVE

SEQ ID NO: 1283 - protein, 46 aa, Acidaminococcus_intestini_RyC-MR95
MGKMYYLGLDIGTNSVGYAVTDPSYHLLKFKGEPMWGAHVFAAGNQ

SEQ ID NO: 1284 - protein, 51 aa, Coriobacterium_glomerans_PW2
MKLRGIEDDYSIGLDMGTSSVGWAVTDERGTLAHFKRKPTWGSRLFREAQT

SEQ ID NO: 1285 - protein, 50 aa, Eggerthella_sp._YY7918
MNLRHVGNYNIGLDMGTASVGWAAIDEQGELLHFKGKPTWGSRLFDSANT

SEQ ID NO: 1286 - protein, 48 aa, Finegoldia_magna_ATCC_29328
MKSEKKYYIGLDVGTNSVGWAVTDEFYNILRAKGKDLWGVRLFEKADT

SEQ ID NO: 1287 - protein, 49 aa, Lactobacillus_rhamnosus_LOCK900
MTKLNQPYGIGLDIGSNSIGFAVVDANSHLLRLKGETAIGARLFREGQS

SEQ ID NO: 1288 - protein, 49 aa, Mycoplasma_gallisepticum_CA06
MNNSIKSKPEVTIGLDLGVGSVGWAIVDNETNIIHHLGSRLFSQAKTAE

SEQ ID NO: 1289 - protein, 47 aa, Streptococcus_agalactiae_NEM316
MNKPYSIGLDIGTNSVGWSIITDDYKVPAKKMRVLGNTDKEYIKKNL

SEQ ID NO: 1290 - protein, 58 aa, Streptococcus_dysgalactiae_subsp._equisimilis_AC-2713
MDKKYSIGLDIGTNSVGWAVITDDYKVPSKKFKVLGNTDRHSIKKNLIGALLFDSGET

SEQ ID NO: 1291 - protein, 59 aa, Streptococcus_gallolyticus_subsp._gallolyticus_ATCC_43143
MTEKNYSIGLDIGTNSVGWAVITDDYKVPAKKMKVLGNTDKKYIKKNLLGALLFDNGET

SEQ ID NO: 1292 - protein, 40 aa, Streptococcus_gordonii_str._Challis_substr._CH1
MNGLVLGLDIGIASVGVGILEKDTGKIIHASSRLFPAATA

SEQ ID NO: 1293 - protein, 58 aa, Streptococcus_mutans_GS-5]
MKKPYSIGLDIGTNSVGWAVVTDDYKVPAKKMKVLGNTDKSHIKKNLLGALLFDSGNT

SEQ ID NO: 1294 - protein, 40 aa, Streptococcus_salivarius_JIM8777
MSDLVLGLDIGIGSVGVGILNKVTGEIIHKNSRIFPAAQA

SEQ ID NO: 1295 - protein, 41 aa, Streptococcus_suis_D9
MSNGKILGLDIGIASVGVGVIDAQTGEIIHASSRIFPSANA

SEQ ID NO: 1296 - protein, 40 aa, Streptococcus_thermophilus_LMG_18311; identical to SEQ ID NO: 1294

SEQ ID NO: 1297 - protein, 49 aa, Treponema_denticola_ATCC_35405
MKKEIKDYFLGLDVGTGSVGWAVTDTDYKLLKANRKDLWGMRCFETAET

SEQ ID NO: 1298 - protein, 63 aa, Lactobacillus animalis KCTC 3501
MGSNMLKKDYSIGLDIGTNSVGHAVVTDDYKVPTKKMKVFGDTSKKTIKKNMLGVLLFNEGQT

SEQ ID NO: 1299 - protein, 51 aa, Lactobacillus ceti DSM 22408
MSKKYQNTKYYVGLDIGTSSVGWAVTDANYELLKVNGHKTWGSRLFTEAET

SEQ ID NO: 1300 - protein, 50 aa, Tissierellia bacterium KA00581
MGKQKFNDYYLGFDIGTNSAGWAVTDLQYKLLRFNKKDMWGSRLFDEAQT

SEQ ID NO: 1301 - protein, 63 aa, Veillonella parvula ATCC 17745
METQASNQLISSHLKGYPIKDYFVGLDIGTSSVGWAVTNKAYELLKFRSHKMWGSRLFDEGES

SEQ ID NO: 1302 - protein, 39 aa, Environmental metagenome
MTKILGLDLGTNSIGWAVVDKENNKIDNCGVRIFPEGVV

SEQ ID NO: 1303 - protein, 58 aa, Enterococcus faecalis OG1RF
MKKDYVIGLDIGTNSVGWAVMTEDYQLVKKKMPIYGNTEKKKIKKNFWGVRLFEEGHT

SEQ ID NO: 1304 - protein, 41 aa, Streptococcus gallolyticus
MKEKYILGLDLGITSVGYGIINFETKKIIDAGVRLFPEANV

SEQ ID NO: 1305 - protein, 41 aa, Staphylococcus pasteuri
MTNGKILGLDIGIASVGVGIIEAKTGKVVHANSRLFSAANA

SEQ ID NO: 1306 - protein, 55 aa, Prevotella histicola
YKEKLELLPKSSLHNPVVEKILNQMINVINAVIDEYGKPDEIRIELARELKIGAA

SEQ ID NO: 1307 - protein, 54 aa, Chryseobacterium gallinarum
KEQLEVLPKNSLRNPVVEKILNQMINLVNATISEYGKLDGVRIELARELKKSAQ

SEQ ID NO: 1308 - protein, 55 aa, Parabacteroides sp.
LKGKLEVLPKNSLRNPVVEKILSQMVNVINTIIDTYGKPDEIRVELARELKKSAK

SEQ ID NO: 1309 - protein, 61 aa, Capnocytophaga canis
LRDSLEVLKKNSLRQPVVEKILNQMINLVNALLKKYRTETPNFKFDEIRIELARELKKNAE

SEQ ID NO: 1310 - protein, 60 aa, Ornithobacterium rhinotracheale
SPDKIEFLKQHSIGNPIVEKIINETLKLIKDIWVIHGKSCKNFFSEIHIELSREIKSSSK

SEQ ID NO: 1311 - protein, 60 aa, Weeksella virosa
LEQYLSEFKQHSLRNPIVEQVITETLRVVRDIWKQYGKGAKDYFDEIHIELGREMKNTAE

SEQ ID NO: 1312 - protein, 62 aa, Flavobacterium frigidarium
NNDRVLKDTLELLKKNSLRNPVVEKILNQMINVINAIIKDPEMGKPDEIRVELARELKANNE

SEQ ID NO: 1313 - protein, 104 aa, Rikenellaceae sp.
KRLERLYHPSMIEAYPSASPNGQGLLQLGSPRIPAVRNPMAMRALFRLRVLLNELLREGKIDRGTKINIELARELNDANKRKAIERYQREREAENRKYAEEIRQ

SEQ ID NO: 1314 - protein, 61 aa, Jejuia pallidilutea
YREFLKEFKNRENINLNVEESISAFELWSEQTFEETNDENGKRISNKGHIEILNEKAALKR

SEQ ID NO: 1315 - protein, 55 aa, Caenispirillum salinarum
LRTWTGNAATDHILNQVRKTANEVITKYGNRRGWDPLPSRITVELAREAKHGVIR

SEQ ID NO: 1316 - protein, 91 aa, Salinispira pacifica
LYHHSQEMSVQNNRYYLSELPNLRNPIVQQALQELRTLVNTLVEQYLPDGEQFSKIKVELARELKLPRDVRRRMHWENNQRAERNNDAKIE

SEQ ID NO: 1317 - protein, 100 aa, Sulfitobacter donghicola
VLDRLPYYGEILDRHVIPGTYDDSDDDITRFGRITNPTVHIGLNQLRRLVNRIIEVHGKPDEIVVELARDLKLSQDQKADVERTIKKNTQAAIRRGEKLE

SEQ ID NO: 1318 - protein, 100 aa, Mucispirillum schaedleri
ASEYLEYYGKVLPDSVVDPQIENPKNDEERYGKIANPTVHAALNQLRKLVNELIKLYGKPEQIVIELARDLKNSRKAKDVINKKIAENRKLNEEVDKTLQ

SEQ ID NO: 1319 - protein, 102 aa, Mesorhizobium sp.
ILDALPYYGKVLQRHILPGMMDPADRKDEAKFYGRIMNPSVHIGLNQLRRLVNALIERFGPPDQIVVELARDLKMSAREKEQEQRRNRDNREANEKRTKKLV

SEQ ID NO: 1320 - protein, 80 aa, Neisseria meningitidis
EEKIYLPPIPADEIRNPVVLRALSQARKVINGVVRRYGSPARIHIETAREVGKSFKDRKEIEKRQEENRKDREKAAAKFR

SEQ ID NO: 1321 - protein, 78 aa, Geobacillus sp.
QKTVLLPTIPPIVNPVVMRALTQARKVVNAIIKKYGSPVSIHIELARDLSQTFDERRKTKREQDENRKRNETAIRQLM

SEQ ID NO: 1322 - protein, 79 aa, Bacillus okhensis
KELLLPVIPNDITNPVVMRALTQARKVVNAIIKRLGEQPLSIHIELARDLLKGHDERRKISNEYKQNHKRNAGAYTILN

SEQ ID NO: 1323 - protein, 88 aa, Tistrella mobilis
HTAQVVSKAGFNALVTELGESIANPIARKALTEGLKQIRAMCARWGLPGAIHIELAREVGNSIEKRRELESQRETTTKRRQTERDEIR

SEQ ID NO: 1324 - protein, 80 aa, Kingella kingae
KTEKFLPNIPADKLRNPVVLRTLTQARKVINAIIRRYGSPARVHIETGREVGKSFSDRDKLKKQQEENQEQRRRAIDEWK

SEQ ID NO: 1325 - protein, 80 aa, Clostridium perfringens
VRTKKLPVIEIDEIVNPVVNRALAQTRKVINSVIDKYGSPVRINIELARDLAKNFKDRKLIEKEQKENRANLDKIRENLR

SEQ ID NO: 1326 - protein, 80 aa, Neisseria sp.
KNQMLLPQIPANEIRNPVVLRTLTQARKVINAIIRRYGSPQRVHIETARELGKSFKDRKEIEKRQEENRKERERAAEHFK

SEQ ID NO: 1327 - protein, 82 aa, Campylobacter coli
FDFLPAFCDSIFAQELTNPIVNRAISEYRKVLNALLKKYGKMHKIHIELARDIGLSKKLRAKIEKEQKENYENNIWALNECE

SEQ ID NO: 1328 - protein, 84 aa, Sulfurospirillum sp.
SHEKSILLPPLKETNIAILNPTVIRAFAQFRQVANALVSKYGSFDKVHFELAREVNTKEDRKRWEKDRDKNEKMHRQITEKLVE

SEQ ID NO: 1329 - protein, 96 aa, Dechloromonas denitrificans
GEGEHKYLPPLYDGRDGDGRMIFAEDADIPRNPVVLRSLNQARKVVNAIIRRYGSPSAVHIEMARDLSRPFDERNKIKKDQDEYQARNQRDREQFS

SEQ ID NO: 1330 - protein, 85 aa, Nitratifractor salsuginis
LRHLHLREGNLFEKEENPINNHAVKSLASWALGLIADLSWRYGPFDEIILETTRDALPEKIRKEIDKAMREREKALDKIIGKYKK

SEQ ID NO: 1331 - protein, 81 aa, Enterococcus cecorum
YSNIDKIDIKNVTENIYNPVVRKSIKKCLKIFNELYKKYPNISDVVIELPREDNPEDARKLIKKMQKENLVEKDTSLEAFR

SEQ ID NO: 1332 - protein, 83 aa, Facklamia hominis
YAEKNQIPVKELLEQIYNPTVTKSVHQSIKLFNEIIEKYGKNNISYVTIEMPRDKNDQDQKDTIKRINKLNSERKNDSEKYFL

SEQ ID NO: 1333 - protein, 80 aa, Streptococcus sinensis
KRTKYIDEKELTDEIYNPVVAKSVRQAIKIINLATKKYGVFDNIVIEMARENNEEDAKKDYVKRQKANEDEKNAAMEKAA

SEQ ID NO: 1334 - protein, 79 aa, Eubacterium dolichum
VKGMKNIQADDTAILSPVAKRAQRETFKVVNRLREIYGEFDSIVVEMAREKNSEEQRKAIRERQKFFEMRNKQVADIIG

SEQ ID NO: 1335 - protein, 81 aa, Streptococcus macedonicus
SKNIKTIDEKEITDEIYNPVVAKSVRQTIKIINAAVKKYGDFDKIVIEMPRDKNADDEKKFINKRNKENKKEKDDALKRAA

SEQ ID NO: 1336 - protein, 81 aa, Turicibacter sp.
FKGLKYIPLDAMVDEIYNPVVRCSIRESIKIINALLKKYGALDKVVIEMPRDSNEKEEKDRITKLNKENDNKKKQAIEKAR

SEQ ID NO: 1337 - protein, 79 aa, Bacillus niameyensis
LKTQTKVMFDGDAILSTVAKRAHREAIKIVNEVRKRYGEMDAIVIETAREKNSEEKRKQYSDFQREIGKHEKEMAKLLG

SEQ ID NO: 1338 - protein, 81 aa, Massilibacterium senegalense
LKGRNQIPVSIVDEWILSPVVKRAFTQSIRIVNAIIKRYGEPSEIVIELARERNSEDRKKFLSKLNRKNAAMNEEVKEKIE

SEQ ID NO: 1339 - protein, 55 aa, Kurthia huakuii
TKKIKYKDVQDLAGSPALKRGIWQAIKVVEELTEIFGEPQHIMLEVAREEGTKQR

SEQ ID NO: 1340 - protein, 56 aa, Streptococcus equinus
DVDDIEAVVHDLPGSPAIKKGILQSVKIVDELVKVMGHNPQNIVIEMARENQITGY

SEQ ID NO: 1341 - protein, 56 aa, Streptococcus equi
KTEYSKDLVGNLAGSPAIKKGISQTIKIVDELVKIMGYLPQQIVIEMARENQTTAQ

SEQ ID NO: 1342 - protein, 56 aa, Enterococcus faecium
DTENLEEIVKELTGSPAIKKGILQSLKIVDEIVGIMGYEPANIVVEMARENQTTGR

SEQ ID NO: 1343 - protein, 56 aa, Enterococcus italicus
EQQSAEEIVSELSGSPAIKKGILQSLKIVDELVAIMGYKPKNIVVEMARENQTTGR

SEQ ID NO: 1344 - protein, 56 aa, Streptococcus agalactiae
HSDNLKEVVGELAGSPAIKKGILQSLKIVDELVKVMGYEPEQIVVEMARENQTTNQ

SEQ ID NO: 1345 - protein, 56 aa, Streptococcus ratti
NSDDLHQVVQDLAGSPAIKKGILQSVKIVDELVKVMGYEPEQIVVEMARENQTTAK

SEQ ID NO: 1346 - protein, 56 aa, Listeria monocytogenes
ADKDIQSIVADLAGSPAIKKGILQSLKIVDELVSVMGYPPQTIVVEMARENQTTGK

SEQ ID NO: 1347 - protein, 56 aa, Lactobacillus sp.
KTDDIEDVINDAYTSPSNKKALRQVLRVVEDIKHAANGQDPSWLYIETADGTGTAG

SEQ ID NO: 1348 - protein, 55 aa, Pediococcus acidilactici
VWENIESILGDAYTSPQNKKAIRQVVKVVQDIEKAVGNPPEKIAIEFTREAAANP

SEQ ID NO: 1349 - protein, 56 aa, Acidaminococcus sp.
AQLSLNDFLDSMYISNAVKRPIYRTLAVVNDIRKACGTAPKRIFIEMARDGESKKK

SEQ ID NO: 1350 - protein, 57 aa, Lactobacillus sp.
QANGVEEILADAYTSPANKKAIRQVVKVVADVVKAAGGKKPAQFAIEFTREPDKNPK

SEQ ID NO: 1351 - protein, 56 aa, Treponema putidum
KRFSYNSLVKPLFLSPSVKKMLWQTLKLVKEISHITQAPPKKIFIEMAKGAELEPA

SEQ ID NO: 1352 - protein, 59 aa, Environmental metagenome
TEKPPLALLPPVCDTDLKRELRNPAVLRALSELRKVVNAVIREFGKPVSIHIELSRDLK

SEQ ID NO: 1353 - protein, 52 aa, Environmental metagenome
EKPEEIQLIPAGELRNPVVEQVINETLQIARDIWIKYGKPDEIHLEMAREMK

SEQ ID NO: 1354 - protein, 59 aa, Environmental metagenome
YEENLKQDLLPALDPKTNIRITNPTVLRTLSEARKVINAVIRKYGKLDRVNIELARDIK

SEQ ID NO: 1355 - protein, 57 aa, Eubacterium sp.
DQHSLRKAVDALYVSPKVKRPILRALLIAKEIEKIQERPPKKIFVEVARGIDNREER

SEQ ID NO: 1356 - protein, 55 aa, Environmental metagenome
SGEKKKDKLPSIPVDMIRNPVVLRALSQARKVVNAVINRYGSPYAIHIEFARDMG

SEQ ID NO: 1357 - protein, 76 aa, Environmental metagenome
HFTGERRERLPYYGEVLARHVIANPDAPEGSQERIGRVPNPTVHIALNQTAKLVNALIEAHGRPDEIVIELARELK

SEQ ID NO: 1358 - protein, 63 aa, Environmental metagenome
RPTGQISDRLPSPSDPDENRRLRSIRNPTVVRCQNELRKVVNNLIDVYGKPDIIRVELARDVG

SEQ ID NO: 1359 - protein, 47 aa, Bifidobacterium bombi
PIYEHTGNPSVDRTFSIIHRWLCNMRDQYGEPETVNIEYVRDGFSST

SEQ ID NO: 1360 - protein, 58 aa, Environmental metagenome
FKGDKSTLLPPLSEQENLEMTNPVVKRAIAQMRLVYNAITRKYGAIDAVHVEFTRDIK

SEQ ID NO: 1361 - protein, 47 aa, Corynebacterium camporealensis
RIGEPVGNPAVDRVLKATARWLEAAHKEWGAPKSIIIEHVRDGFISE

SEQ ID NO: 1362 - protein, 25 aa, Environmental metagenome
KQNHEQRKEESKRQAENQDRNKRLR

SEQ ID NO: 1363 - protein, 57 aa, Environmental metagenome
EKSDPIEKLPSDPRQFEDLRNPTVKRALTELRKVVNNLLATYGKPERIRIELARNVA

SEQ ID NO: 1364 - protein, 59 aa, Legionella pneumophila
PFDGVLARMMQRLAYEIAMAKWEQIKHIPDNSSLLIPIYLEQNRFEFEESFKKIKGSSS

SEQ ID NO: 1365 - protein, 51 aa, Environmental metagenome
QLNKPLLGEPPYVRNPVAQKALYQVRRVVNAVIRRYGKPAQIIVELAREMK

SEQ ID NO: 1366 - protein, 67 aa, Environmental metagenome
EKRELKTRLEILPKNSLRNPVVEKILNQMINVVNTIIDTENDKLEQDGKIRNFQFDEIRIELARELK

SEQ ID NO: 1367 - protein, 60 aa, Environmental metagenome
NERKLLNRLPYGMEADRQIQQLRNPIVIQALFELRKVINELLERFGPFDEIKIELGRDLK

SEQ ID NO: 1368 - protein, 62 aa, Acidaminococcus_intestini_RyC-MR95
TKLQEAYYAKAQLSLNDFLDSMYISNAVKRPIYRTLAVVNDIRKACGTAPKRIFIEMARDGE

SEQ ID NO: 1369 - protein, 60 aa, Coriobacterium_glomerans_PW2
DDFNRAFFAENAQALGVNELPGSPAVRRSLNQSIRIVDEIASIAGKAPANIFIEVTRDED

SEQ ID NO: 1370 - protein, 59 aa, Eggerthella_sp._YY7918
EEENTQSMLEGENLLIEDLPGSPAIRRSINQAVRIVDEIVGIAGHAPDNIFIEVTREDD

SEQ ID NO: 1371 - protein, 60 aa, Finegoldia_magna_ATCC_29328
DKLRKKYIPQEISYEVVENLYVSPSVKKMIWQVIRVTEEITKVMGYDPDKIFIEMAKSEE

SEQ ID NO: 1372 - protein, 62 aa, Lactobacillus_rhamnosus_LOCK900
MAELNQDKLKADDIEDVINDAYTSPSNKKALRQVLRVVEDIKHAANGQDPSWLYIETADGPG

SEQ ID NO: 1373 - protein, 59 aa, Mycoplasma_gallisepticum_CA06
SLKQDKRYLDDRFINDAILSPGVKRILREATKVFNAILKQFSEEYDVTKVVIELARELS

SEQ ID NO: 1374 - protein, 59 aa, Streptococcus_agalactiae_NEM316
DKARTGSHSDNLKEVVGELAGSPAIKKGILQSLKIVDELVKVMGYEPEQIVVEMARENQ

SEQ ID NO: 1375 - protein, 59 aa, Streptococcus_dysgalactiae_subsp._equisimilis_AC-2713
QKAQVSGQGHSLHEQIANLAGSPAIKKGILQSVKVVDELVKVMGHKPENIVIEMARENQ

SEQ ID NO: 1376 - protein, 59 aa, Streptococcus_gallolyticus_subsp._gallolyticus_ATCC_43143
KDAQIIGDIDDVTSVVRELPGSPAIKKGILQSVKIVDELVKVMGHNPDNIVIEMARENQ

SEQ ID NO: 1377 - protein, 55 aa, Streptococcus_gordonii_str._Challis_substr._CH1
TSKRTKYIDEKELTEEIYNPVVAKSVRQAIKIINEATKKYGIFDNIVIEMARENN

SEQ ID NO: 1378 - protein, 59 aa, Streptococcus_mutans_GS-5]
AKAQVIGETDNLNQVVSDIAGSPAIKKGILQSLKIVDELVKIMGHQPENIVVEMARENQ

SEQ ID NO: 1379 - protein, 55 aa, Streptococcus_salivarius_JIM8777
SSNKTKYIDEKQLTEEIYNPVAAKSVRQAIKIVNAAIKEYGDFDNIVIEMARETN

SEQ ID NO: 1380 - protein, 55 aa, Streptococcus_suis_D9
VAEYPSSINVDEITDEIYNPVVAKSIRQTIKIINASIKKWDEFDQIVIEMPRDRN

SEQ ID NO: 1381 - protein, 55 aa, Streptococcus_thermophilus_LMG_18311
SSNKTKYIDEKLLTEEIYNPVVAKSVRQAIKIVNAAIKEYGDFDNIVIEMARETN

SEQ ID NO: 1382 - protein, 63 aa, Treponema_denticola_ATCC_35405
KKINSGFEDAEKQFSYDGLVKPLFLSPSVKKMLWQTLKLVKEISHITQAPPKKIFIEMAKGAE

SEQ ID NO: 1383 - protein, 59 aa, Lactobacillus animalis KCTC 3501
KNAQVIEKEETLAKTVQELPGSPAIKKGILQSLEIVDEIIKVMGYKPKSIVVEMARETQ

SEQ ID NO: 1384 - protein, 63 aa, Lactobacillus ceti DSM 22408
QEYNKEYYGDFTFKAEPSIMDDLYVGPGPKRAIWQAVRIVEEIKRIMGHDPEKIFLETTRTNR

SEQ ID NO: 1385 - protein, 61 aa, Tissierellia bacterium KA00581
DEINGEDDFSNIDIKEYVDKLYVSPSVKRSIIQTYKIAMEIKKITKKDPKKIFIEMAKDKG

SEQ ID NO: 1386 - protein, 62 aa, Veillonella parvula ATCC 17745
QEINAKLTEGQIVNPHDIIDDLALSPAVKRAVWQALRIVDEVAHIKKALPARIFVEVTRSNK

SEQ ID NO: 1387 - protein, 53 aa, Environmental metagenome
EEKEMSDKLSEIENLRNPIVQRAIQEMRRMINELIEKYGKFDRIAVEMGREMK

SEQ ID NO: 1388 - protein, 59 aa, Enterococcus faecalis OG1RF
QKAQSSEHEETLSETVNELAGSPAIKKGIYQSLKIVDELVAIMGYAPKRIVVEMARENQ

SEQ ID NO: 1389 - protein, 55 aa, Streptococcus gallolyticus
NVINKVIEKYGIPEDIIIELARENNSDDRKKFINNLQKKNEATRKRINEIIGQTG

SEQ ID NO: 1390 - protein, 55 aa, Staphylococcus pasteuri
MNELIPELYATSDEQMTILTRLEKFKVNKKSSKNTKTIDEKEVTDEIYNPVVAKS

SEQ ID NO: 1391 - protein, 201 aa, Prevotella histicola
TQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMV

SEQ ID NO: 1392 - protein, 148 aa, Chryseobacterium gallinarum
TQYIAKKAKEILFEITNSVVTTSGRITDKLRKDWDLVNIMKELNLDNYRRLGLTEIVRNSKGEEKELIPDWTKRNDHRHHAMDALTVAFTTRNHIQYLNYLNARKDEKHKEHQNIYAIENIITEVIEKKNGSKTRRFKAPMNSFRHEA

SEQ ID NO: 1393 - protein, 201 aa, Parabacteroides sp.
TQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIE

SEQ ID NO: 1394 - protein, 206 aa, Capnocytophaga canis
TQYIAKKAKEILLQITRNVLSTSGGITDRLREDWDLVNVMKELNLPKYRALGLTEMEDRKYGQQVEVIIDWTKRNDHRHHAMDALTVAFTKHNHIQYLNYLNARKNEKHKEHSNIMGIQQLETIKVTDKNGNEKRVFKAPMPNFRQVAKAFLENVLISHKAKNKVVTKNKNKVAGSNKVQEVLTPRGQLHKETVYGKYQYYVQKEE

SEQ ID NO: 1395 - protein, 228 aa, Ornithobacterium rhinotracheale
TKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHID

SEQ ID NO: 1396 - protein, 222 aa, Weeksella virosa
TRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKE

SEQ ID NO: 1397 - protein, 198 aa, Flavobacterium frigidarium
TQYIAKKAKEILFEVSRNVTATIGSVTDKLRDDWELVEVMKELNWKKYEKLGLTYEEKGKNGERLYKIKDWTKRNDHRHHAMDAITVAFTKPAYIKYLNTLNAQSKDDTKEIYSQYLKRDKNNKLRFIPPMENFREAAKKQLESILISYKAKNKVVTKNKNTTKKSGGTQTKIQLTPRGQLHKETVYGKLQRYETKEE

SEQ ID NO: 1398 - protein, 171 aa, Rikenellaceae sp.
RHYWRMHLDYWRRKCEAFTMTEVPEGFSNRQGVDVGIIGRYARLYLQTVFDRVYTVKGATTAAFRRMWGLQEEYAAKERVNHVHHCIDAITIACIGSREYALWAQYVRQDELYRWGEADKPRCGKPWPTFTEDVRATADELLISHHTPDNMPKQSRKRLRVRGKVQRNDRG

SEQ ID NO: 1399 - protein, 167 aa, Jejuia pallidilutea
TQMISRYAREYLKLYFKKVSVQKGTVTSDFRKLFGFQEEDEIKSRDKHTHHAIDASVLTLIPVNSSKREQILKNYFKSQEDKDKLSLKKLRASVKPSSDFNPQELIRKIEEKTLIVNYQKDKIINQSIKKVRKRGKIQYVKDKQGEFVLDKEGNRIIKYAKGDTLRS

SEQ ID NO: 1400 - protein, 156 aa, Caenispirillum salinarum
HDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDR

SEQ ID NO: 1401 - protein, 457 aa, Salinispira pacifica
YEPEAFLQRQLNDTRYISKAARDYLSTICDQVYVFPGSLTAKVRRMWGLNSILSPPIKTNFEGNAGMYWAVMNDDGVIIELSEQELPPPAIRASDILISGEMKNGIFKVDRKFTGQSQTREVSVEHRTYDSPGWMVYSLLSVEKYLPLFSKLPSQDTKSIWLKGRAQVKDRESPSLMLNSLPVKLMLPPGEYDDNAPYWVNIPVNGELRWEKRGEKPGKNELLIKRTKHRDGKVEAFIDKRKCLFDIPPQDNKSALIIPLDLQEILQVVRMFTPTPAIAEHQFLIKGKIDQSYRFTAESNFRIALDAPEGTPSGPAFAIANCEPRDMRFYPKKNIKPKNGKGKNVLSGFVFQEDGSLVFNPGKNRMDHRHHAIDALTIALLNTGQLRELSGYFLKIKKRQRYSAPKPQFPLPWDNFRADALNSINSILVVHRQNREIIKRIKKNTRLNGRTYVSQGM

SEQ ID NO: 1402 - protein, 143 aa, Sulfitobacter donghicola
DFTARALKDTQYLSRLARTYLDALYDGGDDKSHVWVVPGRLTEMLRRHWGLNGLEALADSDEKTVKRKNRTDHRHHAIDAAVVAATDRSLIQKISKIAASDEQAGAEDTLKSTPPPWDSFRDDIAAQLQNITVSHRADHGRTD

SEQ ID NO: 1403 - protein, 133 aa, Mucispirillum schaedleri
DFIARQLSDTQYLSTRALIYLQSLYEKAHHSSIWTIPGQLTALIRNYLGLNTLISNDKNKNRNDHRHHAVDAFVVAVTSRSLLQKISYAASLQEDLDNRNVSSYRNKLLEKMPEPFPNYRKSLELAIDNIKTS

SEQ ID NO: 1404 - protein, 144 aa, Mesorhizobium sp.
GFQARHLNETKHMSRLAKAYLGKICDPDAVYVTPGALTSLLRGKWGLNSILSDDNLKDRTDHRHHAIDAITIGAMTRSLLLELNTLAGKAEQSDYDDVVGKVPWPFDNFRDAVRSVVDRVVVSNKPEHGKQGALHEDTAYGIVG

SEQ ID NO: 1405 - protein, 171 aa, Neisseria meningitidis
GFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVS

SEQ ID NO: 1406 - protein, 148 aa, Geobacillus sp.
EFKSRNLNDTRYISRFFANFIREHLKFAESDDKQKVYTVNGRVTSHLRSRWDFNKNREESDLHHAVDAAIVACTTPSDIAKVTAFYQRREQNKELAKKTEPQFPQPWPHFADELRARLSKHPKESIKALNLGNYDDQKLESLQPVFVS

SEQ ID NO: 1407 - protein, 144 aa, Bacillus okhensis
VMKERHLNDTRYASRYFKQFVEKSLQFKKSKNQFHKKRVETVAGRVTAHFRQRWGFEKHREGTHLHHALDAIVVACTDAAMIQALSLYHKQKEEGKKGYIKRFPLPWITFRDDVLNKLSESAIPEQIYSALVSGTTLPSYMLVS

SEQ ID NO: 1408 - protein, 157 aa, Tistrella mobilis
RFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEA

SEQ ID NO: 1409 - protein, 155 aa, Kingella kingae
GFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVS

SEQ ID NO: 1410 - protein, 168 aa, Clostridium perfringens
DWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVS

SEQ ID NO: 1411 - protein, 150 aa, Neisseria sp.
GFLERNLNDTRYIARFLCGFIEKSLHLQGAGKRRVFASNGQITALLRGLWGLKKVREDNDRHHALDAIVVACSTVSMQQKITKAMQRRETLETINTETGEVKTRIPQPWDFFRQEVMIRVFSDAPREELAEKLNSRPEALHDFVSPLFVS

SEQ ID NO: 1412 - protein, 146 aa, Campylobacter coli
DFISRNLNDTRYISTLIVKYTKEYLDFLPLDEKEDINLKSGEKGSKIHVQTINGMLTSVLRHTWGFAQKDRNNHLHHALDATIVAYSTNAIIKAFSDFKKEQELLKAKLYAKELTNDSYKHQAKFFEPFEGFREQILNQINKLFVS

SEQ ID NO: 1413 - protein, 139 aa, Sulfurospirillum sp.
EFISRNLNDTRYMSKAIKTYCENHWKLSHDDDKLRIQVRSGKLTSTLRHQWGLDNKNRETHTHHAMDAIMIAFSTQGMVKKLSDYFAKKEAKVEKDKPVLITPIKQFKEAVEQATTLERQESIQTKAGDTITLNRLLIS

SEQ ID NO: 1414 - protein, 166 aa, Dechloromonas denitrificans
EFRERNLNDTRYVCRFFKNYVEQHLKLAEGSETKRCVVVSGQLTNFLRARWGLLKVRSDSDRHHALDAAVVAACSHSMVQRLSNYSRTRELEQVRDGFVDIETGEIVNPAMHQQLREHFPDPWPYFRHELEARLKIDSPELLREEMARLGSYSEEELKVLKPLFVS

SEQ ID NO: 1415 - protein, 147 aa, Nitratifractor salsuginis
NTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSI

SEQ ID NO: 1416 - protein, 141 aa, Enterococcus cecorum
KFIARNLVDTRYASRVVFNELTQFFASKKADTKVAVIRGKFTSQLRRAWQLNKSRDTYHHHAVDAALIGVTPFLKIWRSGKTIYPRKMTEAQTDFELNEITTNDEFKESYYQLPCPQFLDYLTQMQENLKINFEVDKKMNR

SEQ ID NO: 1417 - protein, 149 aa, Facklamia hominis
GFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNR

SEQ ID NO: 1418 - protein, 145 aa, Streptococcus sinensis
KFIERNLVDTRYSSRVVLNALQDFYKLNDFDTKISVVRGQFTSQLRRKWRIDKSRETYHHHAVDALIIAASSQLRLWKKQGNPLISYKENQFVDSETGEIISLTDDEYKELVFRAPYDHFVDTVSSKKFEDRILFSYQVDSKYNR

SEQ ID NO: 1419 - protein, 137 aa, Eubacterium dolichum
EFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNR

SEQ ID NO: 1420 - protein, 146 aa, Streptococcus macedonicus
KFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNR

SEQ ID NO: 1421 - protein, 139 aa, Turicibacter sp.
RFINRNLVDTRYASKVVLNTLQDFMKENYPTTTVEVVRGKFTAQLRRHWGIRKNRDENHAHHAIDALIIACVPHLSLWKEQKKVFSTDEFRVDETTGEIIEQSYNQLTYQEPFSQFFYQLEKVSIDCRYSYKVDRKFNR

SEQ ID NO: 1422 - protein, 137 aa, Bacillus niameyensis
EFINRNLVDTQYAMRSFSMSLRTFFNSHNIDTKVLSIRGSFTAAFRRRARLNKDREESHAHHAIDALIVAAIGRMPIFEFLKEFDMSEEGVVVNRETGEILEENEFFKHKYLSFIRNLMNYESKVKYSHKVDRKVNR

SEQ ID NO: 1423 - protein, 144 aa, Massilibacterium senegalense
EVQKEFINRNLVDTRYVTRELMNLLKTFFSENNKNVKIKSINGSFTHYLRKLWRFKKDRNIDYKHHAEDALIIAMAGYLFSKKEVLAKQNLILSDPHIVNKETGEILSEDDFTKTFIDKYEKVATIKKYQNYKYSHRVDQKPNR

SEQ ID NO: 1424 - protein, 140 aa, Kurthia huakuii
TRQIIKNVGVLLEERFSETTVHLVKAPIVSKFRKALELPKLRNLNNKHHAMDALLNALLINHAIQQYGENIFAFSFKDKERSSKLAKAAQQKNGFFLFNSFLSEQIKGPRSRKTLSAIAYVEEIYYELPWQTTKKIGNSD

SEQ ID NO: 1425 - protein, 182 aa, Streptococcus equinus
TRQITKHVAQILDARFNTKRDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFDIVRKVLSYPQVNIVKKVEEQTV

SEQ ID NO: 1426 - protein, 161 aa, Streptococcus equi
TRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTG

SEQ ID NO: 1427 - protein, 158 aa, Enterococcus faecium
TRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKG

SEQ ID NO: 1428 - protein, 154 aa, Enterococcus italicus
TRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKG

SEQ ID NO: 1429 - protein, 136 aa, Streptococcus agalactiae
TRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVN

SEQ ID NO: 1430 - protein, 173 aa, Streptococcus ratti
TRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTG

SEQ ID NO: 1431 - protein, 158 aa, Listeria monocytogenes
TRQITKNVANILHQRFNYEKDDHGNTMKQVRIVTLKSALVSQFRKQFQLYKVRDINDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKG

SEQ ID NO: 1432 - protein, 142 aa, Lactobacillus sp.
TRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIQELDRIYNFKRMLITHEVHFETA

SEQ ID NO: 1433 - protein, 150 aa, Pediococcus acidilactici
TSQVIKLTANILNGIYDKDTEIIEVPAKMNSQMRKMFDLVKVREVNDYHHAFDAYLTIFIGKYLYKCYPKLRPYFVYGKFKKFGDNEDIEVGDGRFNFLNRIERLKNVTDPETGEILWSNVAPNETIKQIKKVYNYKFMLVSRETTTRRA

SEQ ID NO: 1434 - protein, 129 aa, Acidaminococcus sp.
TRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKE

SEQ ID NO: 1435 - protein, 159 aa, Lactobacillus sp.
TSQIVKLVSVILQNKYPDSEIITVKAGDNSALRQRLNLYKSREVNDYHHAIDAYLSIICGNFLYQVYPKYRPYFVYGKYKKFSQDPDLQKEVIKHFKGFTFMWPLLQKDNSERKAPEKIKENNSDRIVFYKHPDIFDKLRKAYNYKYMLVSRETNTENS

SEQ ID NO: 1436 - protein, 135 aa, Treponema putidum
TRQATKVAAKVLEKIFPETNIVYSKAETVSMFRNKFDIIKCREINDFHHAHDAYLNIVVGNVYNTKFTNNPWNFIKEKRDNPKIGDTYNYYKVFDYDVKRNNITAWEKEKTIITVKTMLKRNTPIYTRQAACKKG

SEQ ID NO: 1437 - protein, 113 aa, Environmental metagenome
AARYLGLLYGIQGSDNRRIIVCAGAVTAYLRQEWDLNRILSAQPVKSREDHRHHAVDALAVALATPAQIKALAECASRAPQVGRRRFAPLPDPWPGFRDQARRAILGTLVSHR

SEQ ID NO: 1438 - protein, 144 aa, Environmental metagenome
YITRRVKEELEKISPVVTTVGSITDYLKEDWKLNKVFKEVQLGRFRSIEKKIDKKLIQEIRINGYHDYQIEGWDKRIDHRHHALDAITIACTNRSIIQTLNNLAQLYESSEPIKNKISRHFPVPAPDFRDQVKNTLETMIVSHK

SEQ ID NO: 1439 - protein, 114 aa, Environmental metagenome
YASRTLKKYLETYLKIGEDDNKVKVLAVNGYLTAELRHQWGLEKDRDANDIHHAVDAVVIALANAGIVKKLANYYKEREYRKHPKFTEPLENFRKVLNEKLVNLPVNRLLVSRP

SEQ ID NO: 1440 - protein, 133 aa, Eubacterium sp.
TQQSTKAVAHILEQLYPKPKTEIVYVKAALVHAFRQSNDMLKCREVNDLHHAKDAYLNIVVGNAYNVKVTHNKVNFIKGLQNNDKGYTVNPEKFFSHDIPGAWSVKDSMNTVRRFMNKNNIRYTRFPRKKQGG

SEQ ID NO: 1441 - protein, 126 aa, Environmental metagenome
YVAREFAGFIRANLLFADPDNKLPLVCINGQVVAQARWLWGLYKDRDENDLHHAQDAAVIAALLPYQIKMITEYSKVVETRRNHIDPETGEIIEWKENERPRLPEPWKGFRKEGVEKLGSILVSRM

SEQ ID NO: 1442 - protein, 127 aa, Environmental metagenome
HMARLAKTYLGTLYGEDAAKRVWSTPGRLTAMLRGMWGLNGLLKDHNRAGADGADVKNRDDHRHHFLDAFVVACTDRGTLQRVATASARAEAMEIDRWAEKGAFPEPFEGYREQISDRIGTMVVSHK

SEQ ID NO: 1443 - protein, 118 aa, Environmental metagenome
YAARESVNMLKQLWPQGGANMPVTVQVVSGRVTAQLRRLWGLNNLLHDGAEKTRADHRHHAVDALVVASCNPGITQSLSRYWKLRESPSAETHPIPLPWPEIRQDATQALDKVIVSHR

SEQ ID NO: 1444 - protein, 183 aa, Bifidobacterium bombi
DNRSMESVSYMARELRNRIYGFYGWHDQDDALKQGRQRVFVSSGSMTAAARRTPFESPLIKGADEETYESSLPWLDGMKGKTRLDRRHHAVDASIIAMMRPQIVKILTEAQEIRSEQHDKYRKGQTPDYVCKRRDYWRNWRGTPDTRDEEVFNYWAGEQLRTLTDLVSQKMADDEIPVIYPTR

SEQ ID NO: 1445 - protein, 118 aa, Environmental metagenome
YISKFVKNYIESHVEFKESKMKRHVYTMNGMLTSQLRYKWGVGDKNRENHLHHAEDAIILAFATQAQVQKLSTTSAKREGFSFKNKEEKAKELRFEPPMENFNEKVKESIENIFVSHM

SEQ ID NO: 1446 - protein, 148 aa, Corynebacterium camporealensis
DNRSIESVAWMANELRSRVAQHFGEYGTKVGVYRGELTAEARNAAGIRRKLRFIDGTGKSRLDRRHHAVDAAVICFTQNYVAEVLAKRSSMRRAAQLNREPEQWREFTGSTDAHRAAWNAWVNKMHLLANLLQTALDEDRIVVTSNLR

SEQ ID NO: 1447 - protein, 113 aa, Environmental metagenome
HLSKVAREYLTLICPQATRVIPGRMTAMLRGKFGLNDVLGLNGEKNRNDHRHHAVDACVIAVTDQGLLQRFAKASASAREKQLNRLVESMPLPWENYREHVQRAVGNILVSHK

SEQ ID NO: 1448 - protein, 115 aa, Environmental metagenome
YIAREARAWLGQLMPRGIFDVEPRNGRIVSRLRKLWHLDRLLGEDGRKNRDDHRHHALDAAVTALFDTRAMQDIVRWYKAQEDRPEEKPPAIDLPWPAFRDDLRTALEAIVVSHR

SEQ ID NO: 1449 - protein, 112 aa, Legionella pneumophila
ARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEK

SEQ ID NO: 1450 - protein, 112 aa, Environmental metagenome
LICRETLGYLKELGVEVCVSRGALTADLRHHWGLNALLSSSEDEKERRDHRHHAVDALVIALTTRRLLQTLSELSSKQGSRSLKDRLRVGLPWPSFREDAKLAIEKIVVSHA

SEQ ID NO: 1451 - protein, 158 aa, Environmental metagenome
YIAKKAKEILFQITKSVVSTSGSITDRLRQDWGLIDVMKELNLPKYEKAGLVEIQHDKNGQPKKVIKNWTKRNDHRHHAMDALTVAFTKHSHIQYLNNLNARKNEDSEKKANIYAIEEKETVKINDGKGNSKRIFKEPILNFRDEAKKHLECVLVSHK

SEQ ID NO: 1452 - protein, 111 aa, Environmental metagenome
YISREAAEYLRQICPKVWVASGQLTARLRHLWGLNSIIDDKSNQKDRSDHRHHAIDALVVAVHTHRDLQLMSRLNRHGISPDSLADAFPFPWPGFRSDAETYVSNILVSHK

SEQ ID NO: 1453 - protein, 121 aa, Acidaminococcus_intestini_RyC-MR95
QSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRF

SEQ ID NO: 1454 - protein, 138 aa, Coriobacterium_glomerans_PW2
LEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRM

SEQ ID NO: 1455 - protein, 150 aa, Eggerthella_sp._YY7918
QSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRM

SEQ ID NO: 1456 - protein, 125 aa, Finegoldia_magna_ATCC_29328
QSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNE

SEQ ID NO: 1457 - protein, 134 aa, Lactobacillus_rhamnosus_LOCK900
QIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHE

SEQ ID NO: 1458 - protein, 147 aa, Mycoplasma_gallisepticum_CA06
YATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRK

SEQ ID NO: 1459 - protein, 172 aa, Streptococcus_agalactiae_NEM316
QITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKK

SEQ ID NO: 1460 - protein, 172 aa, Streptococcus_dysgalactiae_subsp._equisimilis_AC-2713
QITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKK

SEQ ID NO: 1461 - protein, 169 aa, Streptococcus_gallolyticus_subsp._gallolyticus_ATCC_43143
QITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKK

SEQ ID NO: 1462 - protein, 127 aa, Streptococcus_gordonii_str._Challis_substr._CH1
YSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQ

SEQ ID NO: 1463 - protein, 151 aa, Streptococcus_mutans_GS-5]
QITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKK

SEQ ID NO: 1464 - protein, 125 aa, Streptococcus_salivarius_JIM8777
YASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQ

SEQ ID NO: 1465 - protein, 128 aa, Streptococcus_suis_D9
YASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQ

SEQ ID NO: 1466 - protein, 125 aa, Streptococcus_thermophilus_LMG_18311
YASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQ

SEQ ID NO: 1467 - protein, 127 aa, Treponema_denticola_ATCC_35405
QATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQ

SEQ ID NO: 1468 - protein, 144 aa, Lactobacillus animalis KCTC 3501
QITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRK

SEQ ID NO: 1469 - protein, 131 aa, Lactobacillus ceti DSM 22408
QSVKATAEVFKRLYEDSKICYVKAENVSDFRYGSTRKMSKDDQPQPFIKNRDVNDFHHAKDAYLNIVVGNVYDVKFTQNPTRFIKANKDYSLNYIFRYPVNKKGENVWDPEQSMKIVEKTLKSNDVRVTKL

SEQ ID NO: 1470 - protein, 137 aa, Tissierellia bacterium KA00581
QSTKEIAKFFEKIFEKTTVVYSKASLVSEFREKYDIIKVREVNDAHHAQDAYLNIVVGNVFNTKFTKNYWKFTKDIKRQNEENPNEKKGYNLRKIYESDVFCNDSVAWVYSKENPKYNTINTVKDMVYRKTANITRM

SEQ ID NO: 1471 - protein, 126 aa, Veillonella parvula ATCC 17745
QSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKR

SEQ ID NO: 1472 - protein, 79 aa, Environmental metagenome
GEIRFDPKKNRDDHRHHAVDAITIALTDYNNINQLNWYNAQKDKLEKGIPTERPSFDEPWENFFSDAREAAGKILVSHH

SEQ ID NO: 1473 - protein, 145 aa, Enterococcus faecalis OG1RF
QITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKK

SEQ ID NO: 1474 - protein, 128 aa, Streptococcus gallolyticus
VWRFDKYRNHGYKHHAEDALIIANADFLFKENKKLQNTNKILEKPTIENNTKKVTVEKEEDYNNVFETPKLVEDIKQYRDYKFSHRVDKKPNRQLINDTLYSTRMKDEHDYIVQTITDIYGKDNTNLK

SEQ ID NO: 1475 - protein, 122 aa, Staphylococcus pasteuri
QKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQ

SEQ ID NO: 1476 - protein, 160 aa, Prevotella histicola
ERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRD

SEQ ID NO: 1477 - protein, 159 aa, Chryseobacterium gallinarum
EREDMAKSINEATLLHQKYATILKQEFGVVNPSRNDIIRYKLYMELTVNGYKDLYTNTKIEKENLFTDKYDIDHIIPQSRFFDDSFSNKVLVPRQSNLDKGNLTAYDFMSNKGSEREEHFLNVIKELLDKGSISKAKYEKLKKKGLEIGDGFIERDLRD

SEQ ID NO: 1478 - protein, 157 aa, Parabacteroides sp.
EREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRN

SEQ ID NO: 1479 - protein, 160 aa, Capnocytophaga canis
ERANMTANINKAKTEHEKIIKILKNEFGLPNPTRNDIIRYRLYEELKANGYKDLYTNIKIPQEKLFTKEIDIEHIIPKSRIFDDSFSNKTLSFRKTNLDKGERTAFDYMESKFGADKLEEYVARVEDLYRNNIISKAKYQKLLKKESEIGDGFVERDLRE

SEQ ID NO: 1480 - protein, 207 aa, Ornithobacterium rhinotracheale
KRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLND

SEQ ID NO: 1481 - protein, 204 aa, Weeksella virosa
ERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMND

SEQ ID NO: 1482 - protein, 155 aa, Flavobacterium frigidarium
QRSDMTKAINKSTAEHDKIRQLLRTEFGIPRVTRNDIIRYKLWKETEGISIYTGKTIEASRLFTKDYDIEHIIPKSRLFDDSFSNKTICERQLNIDKSNKTAYSFLQEKLSAEDFDQFEKRVKSLFGKISRTKQNKLLMADNEIPEGFIDRQLRE

SEQ ID NO: 1483 - protein, 136 aa, Rikenellaceae sp.
QYVEATGHSIEPSEEDILKYRLWVEQGHCSLYTGKTIGISEFLGDGRRYDIEHTVPRSRGGEDAQYNKTLCEEEFNRDIKRDKLPSELANHTAILACVESCGWFERIEGLEHRVWGADRRAKSATTKSAKDFAIQD

SEQ ID NO: 1484 - protein, 154 aa, Jejuia pallidilutea
YELWMEQKGQCMYTGKMISITQLFSNDIDIMHTIPRWLLPDNTMANMTVGFSKYNRDLQKEKLPKQCDNYSVDVDGWGTSIEPRLEIWKKERDKWKSLFESRRKPKGNEDEEKKNKRIQEKHYFKMHLIYWNDKIERFEADEVKDSWARRQLVD

SEQ ID NO: 1485 - protein, 183 aa, Caenispirillum salinarum
RNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRML

SEQ ID NO: 1486 - protein, 122 aa, Salinispira pacifica
LQKFGLSPSRENIQKYILYKEIQNSVQGQSVQCPYTGQSLAITDVFGNDNKVQVEHIIPYSISLDDSLSNKTLCIAEENGKKGEKTPYQFYKSDPDHWEVVKARAFTLLPYEKAKRFVSTRD

SEQ ID NO: 1487 - protein, 123 aa, Sulfitobacter donghicola
EMGVPNTGGNRMVLRLWEDLNDDDVMKRFCPYTGQRISAGMLFDGSCDVDHILPFSRTLDDGFTNKTLCLKEANRKKRNYAPHEAAEKGLLDRDAMDSVAKYLPDNKAWRFAPDAIERFEGER

SEQ ID NO: 1488 - protein, 132 aa, Mucispirillum schaedleri
EYSEKYNTHIVKNKLNRDKVKLWRELGKDPLERKCIYTGEQINIAKLFSDEVQIEHIVPYSKTLDDSFNNKTLSMKQANYYKGNKTPYEAFKDSKDGYNYDDIIARAKLLNNDNKFKRFTKDAMDIYNRDGK

SEQ ID NO: 1489 - protein, 139 aa, Mesorhizobium sp.
VELGQDNNGENRARLKLYDEQQRAGNGVAHCPFTLDPIGITQLFSPEIEIEHVLPRSRTLDDSAANKVLCFRTINRIKRGKTPWEAFHADPKWPDIAANAEKLPPNKRWRFREDAMDVFEARTSGKMDKTTLEQMGLTT

SEQ ID NO: 1490 - protein, 122 aa, Neisseria meningitidis
EYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDED

SEQ ID NO: 1491 - protein, 122 aa, Geobacillus sp.
EYGLTLNPTGLDIVKFKLWSEQNGRCAYSLQPIEIERLLEPGYVEVDHVIPYSRSLDDSYTNKVLVLTKENREKGNRIPAEYLGVGTERWQQFETFVLTNKQFSKKKRDRLLRLHYDENEEM

SEQ ID NO: 1492 - protein, 129 aa, Bacillus okhensis
ENGIINPRGYDIVRYKLWQEQKQKCAYSGKVIPSETFFGELKKERGQGAPTLDVDHIIPYSKCFNDSYSNKVLVYSDENRKKGNHLPFDYLKESPSRWEEFETYVLTNEFPRAKRERLLKKQFSEDEES

SEQ ID NO: 1493 - protein, 124 aa, Tistrella mobilis
GLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQ

SEQ ID NO: 1494 - protein, 122 aa, Kingella kingae
QFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEK

SEQ ID NO: 1495 - protein, 120 aa, Clostridium perfringens
ELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQR

SEQ ID NO: 1496 - protein, 125 aa, Neisseria sp.
ELFPRFTGEPKSGDILKLRLYQQQQGKCLYSGIPIDLGRLNEKGYVEIDHALPFSRTWDDSFNNKVLVLGSENQKKRNQTPYEYLDGARDSQRWREFQARVQGCRFPYAKKQRIQTAKLDSKTEQ

SEQ ID NO: 1497 - protein, 117 aa, Campylobacter coli
NFGLKANAKNILKLKLWKEQKEFCIYSGKKISIEHLRDEKALEVDHIYPYSRSFDDSFLNKVLVFTKENQEKLNKTPFEAFGANEERWSKIQALAQNLPYKKKNKILDEAFKGKQQQ

SEQ ID NO: 1498 - protein, 120 aa, Sulfurospirillum sp.
EGVKPSYKNILKSKLRSEQKDTCPYCQKNLHYPMIFEDGYAEIDHILPLSQSQDDSYVNKVLVHSACNQNKKNRTPFEWFQDEKKDWDTFKSYILMESTLGEKKRNYLIKENFSDPQSRK

SEQ ID NO: 1499 - protein, 127 aa, Dechloromonas denitrificans
ELFGHPPKGLEFEKWRLYREQNGQCAYSQRPLTASGNVAEIFLDGSTEIDHALPYSRSFDDSKNNKVLVLTRENRDKGNRTPYEYLGGAENSESWQRFVSFVESNKAYRLAKRTRLLRKDFGAKESE

SEQ ID NO: 1500 - protein, 117 aa, Nitratifractor salsuginis
EFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTE

SEQ ID NO: 1501 - protein, 140 aa, Enterococcus cecorum
KEANLSENGLIDFLRKGKNRALKIRLWYQQEGKCLYTGEPILAEDLCKNEANYDIDHIIPISVSFDDSINNKVLCSSHFNRFEKEKKTPFEYFSNKSSHLGRYSNFDEFRASVNANKRISDVKRKNLLSKELLSDLDTRK

SEQ ID NO: 1502 - protein, 132 aa, Facklamia hominis
ERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQR

SEQ ID NO: 1503 - protein, 135 aa, Streptococcus sinensis
HQYNGKKELPDNVFHGHKELATKIRLWHQQGEKCLYTGKNIPISDLIHNQYKYEIDHILPLSLSFDDSLANKVLVLATANQEKGQRTPFQALDSMDDAWSYREFKAYVRGARALSNKKKDYLLNEEDINKIEVKQ

SEQ ID NO: 1504 - protein, 133 aa, Eubacterium dolichum
DDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQK

SEQ ID NO: 1505 - protein, 135 aa, Streptococcus macedonicus
YLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKK

SEQ ID NO: 1506 - protein, 137 aa, Turicibacter sp.
NEYGFGEEAYRQQNDLNTKLRLWYEQKQRCLYSGEIIKIFDLIKNPHLFDIDHIIPKSISYDDSLSNKVLCYATENREKGNLTPYRYFKRKASLTWNYEAYKSYVIELYKDGKGDLSRTKLELLLFEEDINKYEVRQ

SEQ ID NO: 1507 - protein, 132 aa, Bacillus niameyensis
VKSLKDLRLNSKQHLALKLWVSQDRKCIYSGRSISINDIVQDPSKFEIDHILPVSLSFDDSQANKVLCYHRENQKKGQKTPFQYFSTGQASRSFDQFKVEVLNLYKSRKINNKKKDYLLEIRDIAHNEELQK

SEQ ID NO: 1508 - protein, 125 aa, Massilibacterium senegalense
QLGVYDTKGLFEMIKLWHLQDGHCMYSLTPIPLNDLFLNPNHYEIDHIIPRSISFDDSINNKVLVKYIENQKKGNLTPYQYMNRKIDGVSYDKFKQHVLQLAKSSDKMSRKKREYLLEERDINKF

SEQ ID NO: 1509 - protein, 156 aa, Kurthia huakuii
TQSRLMKFKAVVDGLGKDEKSLKNELNSYLNEPEAKFKDNRFYLYLLQQGKCAYSGKPLDVQHLAQYEIDHIYPQNFVKDDSLDNLVLVEKSRNQQKGGFKMPLEILNAAEGARMRGIWKSWLDKGFMNDKKFHRLCKAAFSELDRDQFIARQLVE

SEQ ID NO: 1510 - protein, 158 aa, Streptococcus equinus
GRNKSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKCKFDNLTKAERGGLTETDKAGFIKRQLVE

SEQ ID NO: 1511 - protein, 151 aa, Streptococcus equi
GIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVE

SEQ ID NO: 1512 - protein, 148 aa, Enterococcus faecium
GLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVE

SEQ ID NO: 1513 - protein, 148 aa, Enterococcus italicus
GKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVE

SEQ ID NO: 1514 - protein, 155 aa, Streptococcus agalactiae
GRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVE

SEQ ID NO: 1515 - protein, 152 aa, Streptococcus ratti
GRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVE

SEQ ID NO: 1516 - protein, 151 aa, Listeria monocytogenes
GKNNSRPRYKSLEKAIKEFGSQILKEHPTDNQELKNNRLYLYYLQNGKDMYTGQELDIHNLSNYDIDHIVPQSFITDNSIDNLVLTSSAGNREKGDDVPPLEIVRKRKVFWEKLYQGNLMSKRKFDYLTKAERGGLTETDKARFIHRQLVE

SEQ ID NO: 1517 - protein, 154 aa, Lactobacillus sp.
KRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDETDKFAHGFVARQLVE

SEQ ID NO: 1518 - protein, 154 aa, Pediococcus acidilactici
QRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVE

SEQ ID NO: 1519 - protein, 158 aa, Acidaminococcus sp.
RSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVE

SEQ ID NO: 1520 - protein, 163 aa, Lactobacillus sp.
LSHIRGTKLLKAYQETAGELVDQKLTDSLKEAMTSRKLLKDKYFLYFMQAGRDAYTGQKINIDEVSTNYQIDHILPQSFIKDDSFDNRVLTATPLNAEKSDDVPYKRFANNYVSDLKMTVGEMWKHWQKDGIINKHKLGNLLLDPDRLNKYQKSGFINRQLVE

SEQ ID NO: 1521 - protein, 161 aa, Treponema putidum
RTKTRLKILQDLYNSCKNDADAFSSEIQYLLGKIENEDNLRLRSDKLYLYYTQLGKCMYCGKPIEIGHVFDTSKYDIDHIYPQSKIKDDSINNRVLVCSSCNKNKEDKYPLKPEIQLKQKKFWNFLQRNNFISIEKFNRLTRTTPISDDETAKFIARQLVE

SEQ ID NO: 1522 - protein, 164 aa, Environmental metagenome
RNRKERQQESERMRSRERARSQARTALAPYYGENVPNREIEKYLLWEECGHRCPYTGEVVALSDLFGPYPRFEVEHIIPFDRCLDDSFQNKTLCEINKNREKGKRTPWEAFGHTPEWPSMVERVRAFGNSAKLRRFIIRETEAERLLEEFSSRQLNDARYASRL

SEQ ID NO: 1523 - protein, 160 aa, Environmental metagenome
MNSNERQKLTKAMRDQQKKNEEYEEILKKEFNILKPSRTDIIRYRLYIDQKQRCLYTGKPIQKTQLFNGETDIDHIIPRQRYFDDSYNNKVLCFRNVNEEKSNMTSYEFMQQKGIDKWEDFTRRVNELYKEGLISKKKKNYLLSDEIPKDFINRQLNETR

SEQ ID NO: 1524 - protein, 162 aa, Environmental metagenome
TKKERLKAIQTQNKNIESKKQAEQLLKEKDLNNPSPKKDISKKDILKARLYNQQDGISLYSGEPIKLERLTEDGYCQIDHILPRFKSMDNSFNNKVLCLAEENQNKANDIPYDWLSKTGQFDEFKARVLSMKDKLSYQKVKRLLTEKIDAEGFIERDLNDTR

SEQ ID NO: 1525 - protein, 162 aa, Eubacterium sp.
HRDSRKNRLMELYKNCKKEAEKFCPYFDALSKKLSDEDESKLRRDKLYFYYIQLGKCMYTGEEISLGELMNGNGRFDIDHIYPRSKIKDDSLTNKVLVNKTVNNNKTNVYPIDAAIQSKMSPYWQMLRSSGLISEETYKRLTRKTPLTDDELSAFVSRQLTE

SEQ ID NO: 1526 - protein, 160 aa, Environmental metagenome
KSADKRKEEERRQRENLKEREELEEQFRETFDGREPNGTDMLKWRLYREQRGCCAYSLQPIDLNRLCEPGYVEVDHILPYSRSFDNSRANKVLVLISENRNKLNRTPYEYFGHNEKRWSEYEGWVRTTIRDPRKRGNLLRESFEERQEVEWKDRNLNDTR

SEQ ID NO: 1527 - protein, 157 aa, Environmental metagenome
QNRQQKDEAIRQNRSNETERARMREELASLGYADTPGNMLLLRLYFELPPDERVCVYSGEPISKEMLFSGAVDIDHILPRSKTLDDGFANKVLCTREMNRRKGNRAPADAWSAEELLIIHERSKRLFPRKAWRFAPDAMEKYAENNDFLARHLTDSQ

SEQ ID NO: 1528 - protein, 162 aa, Environmental metagenome
RSKRDREEFQRVIRQRETERKAAIRDLETNGIVQPSRSDIEKWLLWKESGQICPYTGDAIGFDDLFRTGRFEVEHIWPRSRCLDDSFANKTLCRSDINKEKGNRTPYEHLGSNTDQWHRMQDRLKGMVRKGKKPGMAFSKTKRFLAKEIPDDFTHRMLNDTS

SEQ ID NO: 1529 - protein, 147 aa, Bifidobacterium bombi
STQLAEQRERDRRYADNLKMLSNYEGASSRSDVRRIKALQRQNCQCIYCGRTITFETCQMDHVLPRKGPGSDSKFENLVATCGECNKSKSDTLYMNWAKTYPNTNLQDVLRRIQEWSKDGWMTDKRWRQYKEALILRLEATEKQEPL

SEQ ID NO: 1530 - protein, 162 aa, Environmental metagenome
KSHKDRNDIKKSQEEFQALKEEAKAEAIKILGKEPSAKELLKFRLWKEQNGECIYSGAYISPSILADPYATEVDHILPYSRSLDDSLNNKVLCLTKQNQDKGNKTPFEYFGADKDSKEWQEFTGRVEGLKNIKGAKKGRLTKTNFDESSENAFKERNKNDTS

SEQ ID NO: 1531 - protein, 155 aa, Corynebacterium camporealensis
AKAREIDRDNNRRAQRNRELFGKMQSKLGIEGKPRSADLWRFQSVQRQNCCCAYCGDTITFQNCEMDHIVPRAGEGSTNTRDNLVAVCHRCNLAKKNIPFAVWAKNANIPGVSLKEALNRTRHWVEDTGMSSKDFQRFVSNVRARLKRTSVDEPL

SEQ ID NO: 1532 - protein, 169 aa, Environmental metagenome
QNHEQRKEESKRQAENQDRNKRLRSNIAGILKISEEQVSRDDIEKMILWEELSHDVADRKCPYSGVPISASMLLSSEVEIEHILPFSQTLDDSLNNKTVSMRQANRIKGNRTPWEAKQDFEAQGWKFDDILARAGNMKKEKRYRFAEDGYKRWLKDDAGFLPRALNDTR

SEQ ID NO: 1533 - protein, 169 aa, Environmental metagenome
LTGKDKANYMRTLAERERQRKQAAKELKASLGREPTAGDIEKWLLWQECEKTCPYTFDSIGFADLFGNMPRYDIEHIWPRSLSLDDSFANKTLCRRDVNNKKGQRTPFELYASNHGIADLPDWEEVKIHLRNKVDAGHFPESKWKRFTREQPFAAADDRSDDRLIGDTA

SEQ ID NO: 1534 - protein, 157 aa, Legionella pneumophila
DKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQK

SEQ ID NO: 1535 - protein, 156 aa, Environmental metagenome
LSKKQKKALNKQNKRNREANQEAAEQVIRITGVEHPSYDDKLKYRLWKECGGVCPYTGKAISLHELFSDAVDIEHILPYHRTLDDSYMNKTICWADFNRNVKRNQTPWEVLGGDADAWGQLLQRIRSWPKAKRDRMERRSLDGIEDFINRQLNDTR

SEQ ID NO: 1536 - protein, 168 aa, Environmental metagenome
KNAKEREDLSKAINTGKIEHDRIIKILQNEDGIKFPTRNDIIRYKLYQELKNNSYKDLYTNTYIERKDLFTNKYDIEHIIPQSRLFDDSFSNKTIVPRQVNLEKGNRTAYDYILEVKGEKAAEEYTQRIEHMYTQKEDGISKAKYKKLLMKESEIGSGFIERDLRDSQ

SEQ ID NO: 1537 - protein, 164 aa, Environmental metagenome
NPKNRRLEIQRQNKRQQQYHEKVIDRLRELGIDETYDNVLKYKLWEECNATCPYTGRPIAVNQLFSNQIQIEHIIPYSRSLDDSFMNKTLCFSDENARKGDRTPYEYYHGVLGSEKWVDVKQRALSLFKNSRDFPNRYKKFERFVLTSTQDLEGFISRQLNDTR

SEQ ID NO: 1538 - protein, 164 aa, Acidaminococcus_intestini_RyC-MR95
SKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETR

SEQ ID NO: 1539 - protein, 160 aa, Coriobacterium_glomerans_PW2
PKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETG

SEQ ID NO: 1540 - protein, 157 aa, Eggerthella_sp._YY7918
TKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETS

SEQ ID NO: 1541 - protein, 168 aa, Finegoldia_magna_ATCC_29328
EKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETR

SEQ ID NO: 1542 - protein, 159 aa, Lactobacillus_rhamnosus_LOCK900
TAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETR

SEQ ID NO: 1543 - protein, 178 aa, Mycoplasma_gallisepticum_CA06
EEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTR

SEQ ID NO: 1544 - protein, 164 aa, Streptococcus_agalactiae_NEM316
TTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETR

SEQ ID NO: 1545 - protein, 157 aa, Streptococcus_dysgalactiae_subsp._equisimilis_AC-2713
TTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETR

SEQ ID NO: 1546 - protein, 164 aa, Streptococcus_gallolyticus_subsp._gallolyticus_ATCC_43143
TTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETR

SEQ ID NO: 1547 - protein, 173 aa, Streptococcus_gordonii_str._Challis_substr._CH1
EEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTR

SEQ ID NO: 1548 - protein, 216 aa, Streptococcus_mutans_GS-5]
AKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETR

SEQ ID NO: 1549 - protein, 173 aa, Streptococcus_salivarius_JIM8777
EDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTR

SEQ ID NO: 1550 - protein, 173 aa, Streptococcus_suis_D9
EDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTR

SEQ ID NO: 1551 - protein, 173 aa, Streptococcus_thermophilus_LMG_18311
EDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTR

SEQ ID NO: 1552 - protein, 167 aa, Treponema_denticola_ATCC_35405
LEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETR

SEQ ID NO: 1553 - protein, 154 aa, Lactobacillus animalis KCTC 3501
KTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETR

SEQ ID NO: 1554 - protein, 162 aa, Lactobacillus ceti DSM 22408
APKVKNTKRYDALEKKYESVKEHEYAEVKKEFEIEKNDSLNIKKLFLYFTQLGHCMYSDEKIPYNELFTNRYDIDHIYPRSKTRDNSMDNLVLVKAECNRDKKDNYPIKLKTNIQQKCQVRWAYLRDKKLITEEKYNRLVRKTPLTEDELSQFIARQLVFTS

SEQ ID NO: 1555 - protein, 166 aa, Tissierellia bacterium KA00581
EKGKTTEKRKDKIKKLYKNIKDTLSDYCNNLQDLTLQVEKYDDNRLRQKKLFLYFMQMGKSMYTGRCIDLEDLFNNNVYDIDHIYPQSKVKDDSFDNIVLVEKEENHRKSNELLKEEIQSRMNNYWIFLRENKFISKEKYNRLTRKKDFTDEELGDFVARQLVTTR

SEQ ID NO: 1556 - protein, 170 aa, Veillonella parvula ATCC 17745
NEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETN

SEQ ID NO: 1557 - protein, 169 aa, Environmental metagenome
LSKKGRQNVSRMIHQNFEANENVREILKDYQLAPSRQNIQKVLLFNEIQEKAGKVVCPYSGRTLNISDLLGSENKVQIEHIIPRSFSQDDSFTNKTICDAKFNQLKGNLTPYQFYQQNNNKTLWGAATWEEVEQRAYSVLPFNKAKRFTTRKTEWKTEEFISRQLNDDR

SEQ ID NO: 1558 - protein, 157 aa, Enterococcus faecalis OG1RF
TTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETR

SEQ ID NO: 1559 - protein, 173 aa, Streptococcus gallolyticus
NQNAKRIVEKIRLHDQQEGKCLYSLESIALMDLLNNPQNYEVDHIIPRSVAFDNSIHNKVLVKQIENSKKGNRTPYQYLNSSDAKLSYNQFKQHILNLSKSKDRISKKKKDYLLEERDINKFEVQKEFINRNLVDTRYATRELTSYLKAYFSANNMDVKVKTINGSFTNHLRK

SEQ ID NO: 1560 - protein, 167 aa, Staphylococcus pasteuri
VRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLK

SEQ ID NO: 1561 - protein, 73 aa, Prevotella histicola
KVGAALDEVTIKKVSSSFIREALLDRLHEYNGDAKKAFTGRNSIDKNPIYIDEEHKKTVPALVKTIEWEMYHP

SEQ ID NO: 1562 - protein, 133 aa, Chryseobacterium gallinarum
KQHLKEILVSHKTKNKVVTSNINKTKKKGGIHKKTELTPRGQLHKETVYGSKKFLQSREEKVSAKFDYETILMVVNPIHRNALLNRLKEYGNDPKKAFSGKNAINKNPVYLDDSKTDILSEKVTLSWYETGYT

SEQ ID NO: 1563 - protein, 73 aa, Parabacteroides sp.
KVNASFDAAKIATVSKRAYRNALLKRLETFGNDPKKAFTGKNALEKNPLYADKYQTIRVPEKVQTVEFETIYT

SEQ ID NO: 1564 - protein, 73 aa, Capnocytophaga canis
KIGGKFDLETIKKVANPLYQSLLKKRLEENGGDPKKAFTGKNSLAKNPIYLDDAQTEQLPEKVKLVWLENSFS

SEQ ID NO: 1565 - protein, 78 aa, Ornithobacterium rhinotracheale
TIYGIVCKKLPLKSALENYKNIIDENLKHKIKELKEVNKFDNNQIINFFKECNFIFEDNNIQKVEVYDFKDNRDKTIL

SEQ ID NO: 1566 - protein, 19 aa, Weeksella virosa
TVSGKIDLPRVKVSKGKIL

SEQ ID NO: 1567 - protein, 73 aa, Flavobacterium frigidarium
KVNANFTAAHIAKVANKAYREALLKRLEENENDPKKAFTGKNSLAKTPIYISLKDNITVPEKVKLVWLEDNYT

SEQ ID NO: 1568 - protein, 106 aa, Rikenellaceae sp.
EVKYMQGDTARGALHQQTFYGAIERDGEIRYVVRKSLDQLLPADVEKIVDEAVRQKVREAVEAYGFKEATDPTKHTVWMNEEKQIPIRKVRILTGVKNPILLKPHR

SEQ ID NO: 1569 - protein, 63 aa, Jejuia pallidilutea
ELFAQTYLGKIKDVERYDDSSPKRNTENTDWIYKKGKDEFIFVKRENIDKVKSSDKLIKSIID

SEQ ID NO: 1570 - protein, 103 aa, Caenispirillum salinarum
QDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTIL

SEQ ID NO: 1571 - protein, 114 aa, Salinispira pacifica
SVRGQLHKDTVYGKHYIPGSDEPGYHVRKQITDLTSLSKIADAGTHEILRTFVEENGYSIDEKEKVKGEWFTKGNDYQVIMPSSGKPGNPIKKVRIRENLGNAVQWHTGINQYV

SEQ ID NO: 1572 - protein, 101 aa, Sulfitobacter donghicola
SLAKGRGEDTTSGALHEATALGIIDETHVTVRIPIESLKSGHLIEGSRNGYIRDPYLRDQLTLATKNGSDKDFTTVLQKFFDRSKRYGGTRRVRIIKTLQD

SEQ ID NO: 1573 - protein, 82 aa, Mucispirillum schaedleri
HKADRSISGKLHEDTAYGIVENDDKYNVVTRWTVDKFKEQKHFETIRDNELKEIACSDKELFAKIVETRKIKSIRKLAKENP

SEQ ID NO: 1574 - protein, 59 aa, Mesorhizobium sp.
DEAEAEEIGNLVRRKLLVDLTPGEVDRIRDAGLRKAMQAAVAPSRDARGKVSDAKGFAA

SEQ ID NO: 1575 - protein, 119 aa, Neisseria meningitidis
RAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGD

SEQ ID NO: 1576 - protein, 121 aa, Geobacillus sp.
RMPKRSVTGAAHQETLRRYIGIDERSGKIQTVVKTKLSEIKLDASGHFPMYGKESDPRTYEAIRQRLLEHNNDPKKAFQEPLYKPKKNGEPGPIIRTVKIIDTKNQVIPLNDGKTVAYNSN

SEQ ID NO: 1577 - protein, 118 aa, Bacillus okhensis
RMPRRSVTGPVHKETISKDGGVDEKGKTLIVKKVQLQDIKFNKNGDFLMYMEETDPATYKAIKERYLSFNKDAKKAFQDPLYKPSKKGKPNQIKSVKVIVEKKAHVRKVNGGVAENGD

SEQ ID NO: 1578 - protein, 81 aa, Tistrella mobilis
QVFERRGLADLKEADLDRVKDPERNQAIIEAVRAWILAGRPADAPPRSPRGDVIVKLRTAPAKKIKPAVPVRGGTADRGDM

SEQ ID NO: 1579 - protein, 110 aa, Kingella kingae
RMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGS

SEQ ID NO: 1580 - protein, 115 aa, Clostridium perfringens
RVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEG

SEQ ID NO: 1581 - protein, 115 aa, Neisseria sp.
RAPNRKMTGQGHLETVKSAKRLSENISVVKKPLTALKLKDIENIVGYPDREPALYRALQERLQAYKDDPAKAFAEPFYKPAKDGGQGSLVKAVRIIENTKHGLKVRNGITDTNGD

SEQ ID NO: 1582 - protein, 53 aa, Campylobacter coli
KPPRKRARGALHKETFYPKDEMIKKYNSQEGVEIALNCGKIRKIGTKYVENDT

SEQ ID NO: 1583 - protein, 57 aa, Sulfurospirillum sp.
RPPRASVTGAAHEQTAKPYPRIKPIKNKYKRRRIPIDEDKFELFRNDKVASGNDKNF

SEQ ID NO: 1584 - protein, 118 aa, Dechloromonas denitrificans
RAPQRRNGGAAHKDTIYGQPEKLKKNGSVTQKVALTSLTLKDIDLLADPHRNAKLYGAIRERLEAHGGKGDKAFPATNPLRKPDKEGNPTGPIVRTVTKVIDKLSGIPVRGGIAKNDT

SEQ ID NO: 1585 - protein, 131 aa, Nitratifractor salsuginis
SYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRK

SEQ ID NO: 1586 - protein, 149 aa, Enterococcus cecorum
KISDAMIYSSRKKKLSKDKKEKEYSLGTINDIYSDAGYSKFKNIYKKDKEKFLMYHLDHKSFEILEDIISQYPDKEEYIDSEGKVKQRAVSPFEIYRRKYGYIRKYSKKNNGPIIKNMKYYNENLPKIYIDITPKQSIDKKVYLTNISP

SEQ ID NO: 1587 - protein, 161 aa, Facklamia hominis
KISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNS

SEQ ID NO: 1588 - protein, 144 aa, Streptococcus sinensis
KISDATIYSTRKAKLGKDKSEETYVLGKIKDIYTQTGYDAFIKLYKKDKSKFLMYHKDPITFEKVIEEILKTYPDKEINEKGKEVACNPFEKYRQENGPLRKYSKKGKGPEIKSLKYYDNKLGNHIDITPDNSENQVILQSLKP

SEQ ID NO: 1589 - protein, 150 aa, Eubacterium dolichum
SVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISP

SEQ ID NO: 1590 - protein, 145 aa, Streptococcus macedonicus
KVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINP

SEQ ID NO: 1591 - protein, 144 aa, Turicibacter sp.
QVADATIYSTRQGIVKQTSGDKSFTLDSNSKEHYVIAKIKNIYEDVDAKRFMDRYKKDKTQFLMYHHDPQTFSILEDVMKTYPDKKNPFQAYRLEYGPIRKYSKKGNGPQIQSIKYYDSKLGQHIELKQANQSTKKVVLQSLNP

SEQ ID NO: 1592 - protein, 127 aa, Bacillus niameyensis
TMSNQTIYGTREKDGDTYYLGKVSNIYNLDKHGVEPLLKRLEKSPNSFLIAEHNPKLFELIQLIVKEYKNADNPFKAYYNDHGYVMKDGKVPVKTLRYRDRKLGVHMKITDKYPGAKSDVVLLSIKG

SEQ ID NO: 1593 - protein, 126 aa, Massilibacterium senegalense
QLMNDTICSTRTVDNNEYVIKKIKDIYAKDNTDLVNKIRKSPKKLLMYHNDRQTYEKIKSIMEQYGDAKNPLYKYKEETGEFVTKYSKKDNGPPILSVKYYSGKLGEHKDITHKFHNSKKRVVNLS

SEQ ID NO: 1594 - protein, 20 aa, Kurthia huakuii
EMFFDETLHSPKIKPAKYES

SEQ ID NO: 1595 - protein, 44 aa, Streptococcus equinus
GQNGGLFDNNILAKPEKDDKKKLFPIKNSLSTTSYGGYARATIA

SEQ ID NO: 1596 - protein, 37 aa, Streptococcus equi
GFYKESILSKGNSDKLIPRKNNWDTRKYGGFDSPTVA

SEQ ID NO: 1597 - protein, 37 aa, Enterococcus faecium
GFSKETVEPKKDSSKLLPRKNNWDPAKYGGLGSPNVA

SEQ ID NO: 1598 - protein, 37 aa, Enterococcus italicus
GFSKESIQPKGESQKLIRRKQQWNTKKYGGFDSPVVA

SEQ ID NO: 1599 - protein, 37 aa, Streptococcus agalactiae
NDTGEIVWDKKKHFATVRKVLSYPQNNIVKKTEIQTG

SEQ ID NO: 1600 - protein, 37 aa, Streptococcus ratti
GLTNETIYPRGSFDKLLNRKNTLEASKYGGFGSPTVA

SEQ ID NO: 1601 - protein, 37 aa, Listeria monocytogenes
EFSKATIKPKGNSSKLIPRKTNWDPMKYGGLDSPNMA

SEQ ID NO: 1602 - protein, 43 aa, Lactobacillus sp.
DLFDQTIYAAKDSKERGGRMSLIPKKLGYLTGIYGGYQTERGS

SEQ ID NO: 1603 - protein, 37 aa, Pediococcus acidilactici
ELFNQTVYPKNYRGKLIPIKEDRPTDLYGGYSGNTDA

SEQ ID NO: 1604 - protein, 35 aa, Acidaminococcus sp.
GLFDIQPLKASTGLVPRKAGLDVVKYGGYDKSTAA

SEQ ID NO: 1605 - protein, 42 aa, Lactobacillus sp.
GLFDVTIYPRGERDLAKTRKLIPKGNGLDPKIYGGYSGNSGA

SEQ ID NO: 1606 - protein, 63 aa, Treponema putidum
ELFNQTIMKKGLGQHPLKKECPFSNISKYGGYNKVSAAYYTFIEYEEKGNKIRSLETIPLYLE

SEQ ID NO: 1607 - protein, 113 aa, Environmental metagenome
PQRKLKAALHEDTYYSPPVERDGKLSVRCRKPVNSLSANEINAIVDPTVRETVRKAWEEVGRDSKKLLNNWPLLQTRRGDLVPIKRVRYYKTQQVQPIAAEDPARTRYVIPGG

SEQ ID NO: 1608 - protein, 222 aa, Environmental metagenome
SRRRLITKKRAYYKVLDPSTGAYILKKQEKPSPVVRGPLHDEQPLGEIKEYQKIKIKDAIKKLEENKNNLDKFINGTFPIEWQRKKINEKLSIYNNDPKLFLKNLNKDAILNLKGEKLEYITILVRKYVKSRDLNTSITLSQIENIIDRKLKNEIKNHLKQYNNDPKKAFTDEGLMLFNQNRKFPVYKVRCKVDESEVGTLTTREPLERDSENNPKLHIEKG

SEQ ID NO: 1609 - protein, 39 aa, Environmental metagenome
PRKKVTGQAHKETVISPKNKDHSMIEIHKGRGYAEQSLM

SEQ ID NO: 1610 - protein, 51 aa, Eubacterium sp.
LFKINPLKKGNGQVPLKASGARSCIEKYGGYDKATSAYFSYVEYTDKKGKA

SEQ ID NO: 1611 - protein, 111 aa, Environmental metagenome
PQRKVSGAIHADTIRSAKHISTDRVSVVKKPLNSLSENDLKNLFDTEHNKLLYSAIRQRMAEFDNKAQKAFAEPLFKPLRDGSPGPMVRSVKVCQAQYTGVNVRGGIADNG

SEQ ID NO: 1612 - protein, 122 aa, Environmental metagenome
PDHGITPGRARERQATSGQLHEDTAYGRVDEQVNGKTYNLVTRKPIGALTKNEIGQVRDVRIREALQEVAYEADRDGIKLGEALARFGEENGIRRVRVLKTDKTAIALTHGDGRFHKTYVPG

SEQ ID NO: 1613 - protein, 113 aa, Environmental metagenome
VSRKLSGPLHEETHFGDTGLEAVRRGTIYRQYVRRKPLHELSPKELDCIRDPAVQSIVRKWVNARGGDPKKAFSDGYPKLGTNGPEIKKVRLVVEKRPELTIHTGSGVVDKGK

SEQ ID NO: 1614 - protein, 116 aa, Bifidobacterium bombi
LRLGNGSAHKDTVVSMMTRKVGDELSITAINKAESGALYTALTRDSDFDWKTGLSANPNRRIRVHDKWFEADDTIKFLEPAVEVVLKNNTRARIDPEALDKVHSTLYVPVRGGIAE

SEQ ID NO: 1615 - protein, 55 aa, Environmental metagenome
PRRKVSGSAHKETVYSNKTHSVKKADGKVEYLKGNSVNNNVKLKHGIALNDSMPR

SEQ ID NO: 1616 - protein, 93 aa, Corynebacterium camporealensis
LRLGNGRAHEDTIGELKKIRVGDAISVTDIDRASTEALWCALTRDPDFDPKEGLPENPHRRIRIHGTWYDADDHIEVFPVGAGAIKVRGGYAE

SEQ ID NO: 1617 - protein, 72 aa, Environmental metagenome
PDHSHEGAMHNDTAYGLRDGGKVSFHKMVDGKRERTEESLKVIKISDAKAIERHGVLPTGEPKPYKGYKGDS

SEQ ID NO: 1618 - protein, 129 aa, Environmental metagenome
ALEAIVVSHRVRRKVNGPLHDETRLGDSGEPPIREGGKEYRFYVKRKALAQMSKGEIDAIRDERIRTLAQERLAAHDGDVKKAFATPLMLPGRAGKPDREVKKARVIVKSQPHLVTALNGGKAYAAASD

SEQ ID NO: 1619 - protein, 230 aa, Legionella pneumophila
YNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPG

SEQ ID NO: 1620 - protein, 114 aa, Environmental metagenome
AARKIAGALHEETAYGCRKDGRYVYRKPLNGLFKREHAKDIVDPQIKKIVLEHLDRHGNDPKKAFIPENLPLLKDGAGFRPIKKVRVFAKHRPTSVFAVRDRHGRDFKFLKYGS

SEQ ID NO: 1621 - protein, 214 aa, Environmental metagenome
AKNKVVTRNINKIKGSDKKQIALTPRGQMHKETVYGRIKQYNSKIEKVSAKFDEDTIAMVSNPQYRSLLLQRLKENGNDPKKAFTGKNALDKAPILLKNGTPLPDKVKLIWLEDNFTIRKEINPDLKIDKVIDEGIKRILQKRLDEFKGDPKKAFADLENNPIWLNKEKGIAIKRVTISGVKNAEALHTAKDHLGNKRLDKNGQEIPVDFVSTG

SEQ ID NO: 1622 - protein, 151 aa, Environmental metagenome
TNHRVVSTRLTITRSKGKVFRNKSSAARGALHKETVYGKRKLLDGSYKYHVRKSLEDIKEKAQVDKIVDQKIKDLVRNRLRELGVDITMKKYKVPPGAFFSKDENGQILPLIWLPNNRGGKVPVYSVRINEELGNAAQLKSSQNQYVNPRN

SEQ ID NO: 1623 - protein, 42 aa, Acidaminococcus_intestini_RyC-MR95
SFDRKEGLFDIQPLKASTGLVPRKAGLDVVKYGGYDKSTAAY

SEQ ID NO: 1624 - protein, 45 aa, Coriobacterium_glomerans_PW2
PFEDHGVFWDATIYSPRAKKTAALPLKQGLNPSRYGSFSREQFAY

SEQ ID NO: 1625 - protein, 45 aa, Eggerthella_sp._YY7918
PMEDSGAFWDATIYSPKAGKKGALPVKQGLPVEKYGSYSREQFAY

SEQ ID NO: 1626 - protein, 50 aa, Finegoldia_magna_ATCC_29328
SHVKKGELFNATIAGKKDYKKGKIYLPLKKDDRLQDVSKYGGYKAINGAF

SEQ ID NO: 1627 - protein, 50 aa, Lactobacillus_rhamnosus_LOCK900
VYFETADLFKQTIYAAKDSKERGGSKQLIPKKQGYPTQVYGGYTRENTAY

SEQ ID NO: 1628 - protein, 189 aa, Mycoplasma_gallisepticum_CA06
IENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTIN

SEQ ID NO: 1629 - protein, 47 aa, Streptococcus_agalactiae_NEM316
TEIQTGGFSKESILAHGNSDKLIPRKTKDIYLDPKKYGGFDSPIVAY

SEQ ID NO: 1630 - protein, 44 aa, Streptococcus_dysgalactiae_subsp._equisimilis_AC-2713
TEVQTGALTNESIYARGSFDKLISRKHRFESSKYGGFGSPTVTY

SEQ ID NO: 1631 - protein, 47 aa, Streptococcus_gallolyticus_subsp._gallolyticus_ATCC_43143
VETQTGGFSKESILPKGNSDKLIPRKTKKFRWDTPKYGGFDSPNIAY

SEQ ID NO: 1632 - protein, 149 aa, Streptococcus_gordonii_str._Challis_substr._CH1
VDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSR

SEQ ID NO: 1633 - protein, 47 aa, Streptococcus_mutans_GS-5]
VEEQTGGFSKESILPKGDSDKLIPRKTKKFYWDTKKYGGFDSPIVAY

SEQ ID NO: 1634 - protein, 150 aa, Streptococcus_salivarius_JIM8777
VDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVS

SEQ ID NO: 1635 - protein, 147 aa, Streptococcus_suis_D9
VDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLK

SEQ ID NO: 1636 - protein, 151 aa, Streptococcus_thermophilus_LMG_18311
VDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLK

SEQ ID NO: 1637 - protein, 46 aa, Treponema_denticola_ATCC_35405
QAACKKGELFNQTIMKKGLGQHPLKKEGPFSNISKYGGYNKVSAAY

SEQ ID NO: 1638 - protein, 44 aa, Lactobacillus animalis KCTC 3501
AERQIGGFSDEMLVPKSDSGKLLPRKEGLDPVKYGGYAKAVESY

SEQ ID NO: 1639 - protein, 51 aa, Lactobacillus ceti DSM 22408
VKPITSPISNETLHKALKCKPGSYLPRKSSKGTPLADVTKYGGYEKIKNAY

SEQ ID NO: 1640 - protein, 60 aa, Tissierellia bacterium KA00581
LVEGKGQLFNLTIKDKTQLKKNVGNIVANTPISLKNRKLHLNSVEIAKKYGYFDSLNNAY

SEQ ID NO: 1641 - protein, 53 aa, Veillonella parvula ATCC 17745
LLEQTGALADATIYKATVAGKAKDGAYIGMKTKSSVFADVSKYGGMTKIKNAY

SEQ ID NO: 1642 - protein, 164 aa, Environmental metagenome
KDNTVTKKVTMIIEKNGKKFRSEGQAVRGQLHKETVYGKRTPPRAEQAFHVRKPIESLNDKQLDKIVDDNVRSIVKYGREREKFIKEQIKALQKDRTKAGDEEEKKIDQQIKSLEEENRQLYTLPNKNGDRVPIKKVRIRENLGNTEMLKPSENINQYVNPRNN

SEQ ID NO: 1643 - protein, 44 aa, Enterococcus faecalis OG1RF
VEVQKGGFSKESIKPKGPSNKLIPVKNGLDPQKYGGFDSPVVAY

SEQ ID NO: 1644 - protein, 151 aa, Streptococcus gallolyticus
KQFNKNPEKFLMYQNDPKTFEKLSIIMKQYSDEKNPLAKYYEETGEYLTKYSKKNNGPIVKKIKLLGNKVGNHLDVTNKYENSTKKLVKLSIKNYRFDVYLTEKGYKFVTIAYLNVFKKDNYYYIPKDKYQELKEKKKIKDTDQFIASFYK

SEQ ID NO: 1645 - protein, 135 aa, Staphylococcus pasteuri
TGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDV

SEQ ID NO: 1646 - protein, 254 aa, Prevotella histicola
TRKMISPDLKIDKVIDKGIREILRTRLAKFNGDAQKAFSNLDENPIYKDEAKKITLKRVSLEGVSSVIPLHKLKDMGGKPVVGKDGKPVWGDYVQTSNNHHIAFYMDENGNLQDDVVTFFKAARRKSQGVPVIDKNYNHDKGWHFLFTMKQNEYFVFPNEATGFIPTEVDLMDEANYDMISPNLYRVQKMSKTKQGITDKRDYWFRHHLETVLNNDLKVRNSIFKQINSLKPLEGIVKVRINAIGKIVAIGEYD

SEQ ID NO: 1647 - protein, 256 aa, Chryseobacterium gallinarum
IRKSVTPDNFKDYKNLEKITDLGIKKILKERLDQFKGNAKEAFSNLDKDPIWLNEEKGIAIKTVTITGVSNAESLHFKKDHLGKEILDENGNKIPGDFVSTGNNHHLAIYLDEEEKLDDKMVTFYEAVLRVNQGLPVIDKDYNKEKGYKFLMTLKQNEMFVFPNEDFDPNEIDLLDERNLERISKHLFRVQKISKVGYGNSFVRDFVFRHHLETTVEERKELRNITYIQLKSLEGLRNIIKVRLNHLGKIVQIGEY

SEQ ID NO: 1648 - protein, 269 aa, Parabacteroides sp.
IRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 1649 - protein, 258 aa, Capnocytophaga canis
IRKDITPENFKDEKLIDKILDEGVKRILKERLQSFGNDAKKAFSDLDKNPIWLNKEKGIAIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQTISVVKYGNAIVRDFKFRHHLETTVEDKKELQGKTYQQIKSLSPLNDIIKVRINHLGDIVSVGEY

SEQ ID NO: 1650 - protein, 267 aa, Ornithobacterium rhinotracheale
SSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 1651 - protein, 232 aa, Weeksella virosa
TATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 1652 - protein, 245 aa, Flavobacterium frigidarium
IRKDITPDNFKDLKSIAKVMDSGLKTILENRLAEYGNDPKKAFSNLDENPIWQNKEKGIAIKRVTISGVSNAQALHTKKDHLGNEILDQEGKPMPVDFVSTGNNHHVAIYRDEKGNLQEEVVSFYDAVIRRNLGLSVINKNHEKGWDFLFSMKQNEFFIFPSDSFNPHEMDLQNPTNYHLISRYIFRVQKIATKDYTFRHHLETTVEDKKELKDISSKRLGLNGINDIVKIRINHLGKIVQIGEY

SEQ ID NO: 1653 - protein, 18 aa, Rikenellaceae sp.
DVSVKEYKRYYHVVNDGN

SEQ ID NO: 1654 - protein, 292 aa, Jejuia pallidilutea
PVIRNLVEEQKKNTIVKDYQGNVIRHIRIRTKSGREVKERINYRSRYDYKNKFYSEAGKIPYAVLLQKSINGEIEREMIPVASFEVAKVFKKHRKFNPELYMNEFHPDIGNWDKKNWLKVGQKVIVLKNDKEFEKRDDIDFQHKRMYVITQFSDGGIWLQYHLNAQSKDDVKKSISLAKDKLLRKYEIQYNIPEVIEDESIQDRKNRTADYNNRRFRFDTISKSFRLTTLMETIGEKRTKKIKAELDKYKAIPSSIEIEGETALLKMSKENWNYLYEGTDFEVTILGKLNWL

SEQ ID NO: 1655 - protein, 339 aa, Caenispirillum salinarum
KEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 1656 - protein, 136 aa, Salinispira pacifica
NPRNNYAFIIYRDSDGNYKEHPVTFWDAVQARLAGKSVYQLPEPGKIITTLHINDTFLLGLGDEQLQGDLPQELVSRHLYRVQKLSSMYYCFRLHTESTLDRDFEPYYLGIQSFKAWKEQNPLRVKVATTGEVNLE

SEQ ID NO: 1657 - protein, 145 aa, Sulfitobacter donghicola
TARISVPHNAPIKAYKGGSNHAFEIWRLPNGKIESQVITTWEHHNLTEPKRPHPAAKRIIRLHKTDMVAIERDGKTVICFVQKTDPSNGAFLVPHFEANADGRKRKNEPVEWYQMSANSLIKADLRRVGVDEMGRVRDPGPPPIR

SEQ ID NO: 1658 - protein, 149 aa, Mucispirillum schaedleri
VIKIKDKSGRDYKAFAGGNNICVEIYEVDGVRKSEVIQLFDAAQKGFMPEWMKKYPNGKLLMRLFKGDVIGFIENRKYNYYTIKGISIADQNLKLLAINKAEGIFKKGLNILFDSNNKNSLNAKQFNISVTGIVTKKKTADVNFWKNRK

SEQ ID NO: 1659 - protein, 172 aa, Mesorhizobium sp.
ALDTFAKAQGMRRIRVGKEDMSAVTIHDRQTDKAYKAVAPGENHHVDVVQMRDGAWKGFAVTVFEANQKDFRPQWEREKLGGKLVMRLHKGDAVELESSGVRLVKFVQQIWMKSNLVLLTEHNEGGDLQKRHQDADDPFRWDFANIGKLKERGCVAVKVDELGRVTKRISNT

SEQ ID NO: 1660 - protein, 132 aa, Neisseria meningitidis
MVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 1661 - protein, 162 aa, Geobacillus sp.
IVRIDVFEKDGKYYCVPVYTMDIMKGVLPNKAIEPNKPYSEWKEMTEDYTFRFSLYPNDLIRIELPREKTVKTAAGEEINIKDMFVYYKTIDSANGGLELISHDNSFSLRGVGSRTLKRFEKYQVDVLGNIYKVRGEKRVGLASSAHSKTGETIRPLQSTRD

SEQ ID NO: 1662 - protein, 142 aa, Bacillus okhensis
LIRIDFFQKEGKFFMVPLYTYDTIQSDLPNRYVVSGKGYQLWPQLTNEHKFIQSVHPYELLRVVKRSGDDRFLYLASINISNNVLKFIEPNFPHNDYIEISLGTIKHMEKYDVNVLGQVSLKATGPRLGFNNMKAQKNKVKG

SEQ ID NO: 1663 - protein, 149 aa, Tistrella mobilis
VRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 1664 - protein, 136 aa, Kingella kingae
MVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 1665 - protein, 227 aa, Clostridium perfringens
IYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 1666 - protein, 138 aa, Neisseria sp.
MVRADVYQKADKKGKRQYFIVPVYAWQVEKNELPTVDCKGYEIDDTYEFCFSLYKYDIIEIQNPDNMSKELRVYYINCDSSDGRFWLAHHDKSAKEQQFRISTQNQPIIKKYQVDPLGKEIRLCKAEKRTELNGKKKK

SEQ ID NO: 1667 - protein, 164 aa, Campylobacter coli
MVRIDIFKKQNKFYAIPIYTMDFALGVLPNKIVIAGKDKKGNPKQWQEIDESYEFCFSLHKDDLVLIQKKDMQEPEFAYYNSFDIGNSSICVEKHDNKFENLTDNQKLLFVNAKEGSVKAEKLGIQGLKIFEKYIITPLGEKIKADFKPREDIALKTSKKHGIR

SEQ ID NO: 1668 - protein, 195 aa, Sulfurospirillum sp.
YNSSTIPRVDIYKKDDKYHVVPIYLSDMTKAEVPNKSLGTNPEGMDEKYFCFSVFKNDLIELETKATPKKPSKKLLGYFKQLNGANFILNSIHNGIIDGFVCSPITLFKQQKDMCKKCLPEDRAIGNCSQETLEFWEAENIKVPKKDFECDQGIKFAIAVRKYTIDPLGYYHEVKGEKLLGTIPQGAKKHPKRQK

SEQ ID NO: 1669 - protein, 134 aa, Dechloromonas denitrificans
MLRVDVFTKGGKFHLVPVYVHHRVTGLPNRAIIAFKDEDEWTLIDDSFDWCFSLYPNDLLRIKLKKESHSGYYSSCNRSTGAVNLWAHDRNVNVGKDGFIESIGVKMAVSIEKLHVDTLGNIYPAPPEKRRGLA

SEQ ID NO: 1670 - protein, 170 aa, Nitratifractor salsuginis
MRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 1671 - protein, 161 aa, Enterococcus cecorum
WRTDVYYNRSQNSYHIMGIKYSDLRYIDGKYGIPKNVYEKIKLREKIPSESEFCFSLYKNDRVKIIDPNKNEEIELRFNSRTLPSVLNYVEFKPLFQESYNSLTLLPVFSKTTSEGRIIKKFTREDNIVYKVNTDELGNPYYILKESQNPKNIIDNSNKTE

SEQ ID NO: 1672 - protein, 151 aa, Facklamia hominis
WRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 1673 - protein, 156 aa, Streptococcus sinensis
WRTDVYFNHKTKIYELMGLKYSDLSFEKGSGKYRISLDKYNVIKKKEGVHKESEFKFTLYKNDLILIKDLEKSEQQLFRYNSRNDTSKHYVELKPYDKAKFEGNQPLMALFGNVAKGGQCLKGLNKANISIYKVQTDVLGNKRFIKKEGDAPKLEF

SEQ ID NO: 1674 - protein, 158 aa, Eubacterium dolichum
YRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 1675 - protein, 162 aa, Streptococcus macedonicus
WRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKEGDKPKLDFKNNKK

SEQ ID NO: 1676 - protein, 157 aa, Turicibacter sp.
WRCDIYYNKKDKRYIAAGLKYADLSYQKGTGLYGISLQRYQQILNSEKIELSIEQIELLLEGRLNESNFEFCFSLYKNDFIQWNDENNQTFQYRFLARNLSSPNRIEVKPINKSKYDKQAEGLKTLKKGLNRFYKISVDVLGYQHFIKKEKLKLTFK

SEQ ID NO: 1677 - protein, 138 aa, Bacillus niameyensis
VRVDLYKNAEGKYKYLGVPYHWFKQQGNKYVLDMEKYNEEKMKDYKKIDDTFEFQMSLYKNDLFSFERKEGSYFRIFRGDAMPRDNKIEVDFIDKKKQDRKDGFLSPSTFKNIVKYNVDVLGNTYKVEKENFKNTLQL

SEQ ID NO: 1678 - protein, 150 aa, Massilibacterium senegalense
IKPFRMDVYKEDGIYKFVTVRFNDLKEKGDNYEICKKIYEEKLKKKKINNKSNFLFSLNKYDIFELDNEEFLFIGVNHDKTNRIECNWINQNYKNFAELNNLKNKQLRKSISKNIIQFEKFATDVLGNRYKVTNEKLIFSYPKKSMRGVR

SEQ ID NO: 1679 - protein, 219 aa, Kurthia huakuii
NKTNLSVHDSVKSSAVIVVKLMEQTKKQIVEKIDLIQLSVLEDKQWQHLSNDEKALKLASRKYSTKKIIAATWIMKLSKYQKFMWNNQMFYLASMKERHLATQFIVPKELLMAYLQANEQTSVAKLQTIYATIAEEMFKQYPIYREGNMPKKVAEFTKDIQNFEQMTKQVTEIFKATANNATRSDSLGSRLSKVMKAAEIKVVYESITGLKVRKPKELY

SEQ ID NO: 1680 - protein, 219 aa, Streptococcus equinus
YSILIVSESRERKELKLLGLPLLDKVKYEKNPTAYLNGIGIVNIKNIFKLSKYCLLEFKEKSITYHRYMVSNQELKRANQLSLTCKETELIYTYIKSGEDNIQLDGNEKVILSLWNKMIAFMEQTKLIDKKLFVSLKELKDEVNLINILDIASKSIDFTKISAGQKKIVLNDSLSLPIKRWQFKSDEKMLKQLNDATLIHQSVTGLYETRIDLSKLGEE

SEQ ID NO: 1681 - protein, 228 aa, Streptococcus equi
YSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 1682 - protein, 213 aa, Enterococcus faecium
YTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 1683 - protein, 215 aa, Enterococcus italicus
YAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 1684 - protein, 215 aa, Streptococcus agalactiae
GFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFT

SEQ ID NO: 1685 - protein, 232 aa, Streptococcus ratti
YCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 1686 - protein, 213 aa, Listeria monocytogenes
YAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEASDGKSLDYIESNREMFAELLAHVSEFAKRYTLAEANLNKINQLFEQNKEGDIKAIARSFVDLMAFNAMGAPASFKFFETTIERKRYNNLKELLSSTIIYQSITGLYESRKRLDD

SEQ ID NO: 1687 - protein, 241 aa, Lactobacillus sp. [sequence omitted]

SEQ ID NO: 1688 - protein, 241 aa, Pediococcus acidilactici
YLAIVALEDKKKGKYFKVVGIPTRAAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 1689 - protein, 255 aa, Acidaminococcus sp.
YYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 1690 - protein, 228 aa, Lactobacillus sp.
YMVIVKIEQAKKSIYKVIGVPMRTLASLNQAKKQGNYQGELHKVLEPQIMFDNKGKPKRGVKGFRVIKDHVPFKQVVLDGDKKFMLYSDQYEANAKQLTLSQETMRIVTDNLKKGEDQDQLLVEAYDEILQKVDQYLPLFDMKGFRNGLHKGRDKFIELSTNDKKSTLSNILNGLHDNMVEIKMEYLGIRTPFGRLQSSSGINLSPDAVLIYQSPTGLFEKRVKIADL

SEQ ID NO: 1691 - protein, 236 aa, Treponema putidum
KDIQKSQDGLKGYLTDQLGKKEIKILVPKIKINSLLKINGFPCHITGKTGASFVLRPAVQFCCSNDEVLYFKKIIRFNEIRSQREKMGKTISPYEDLSFRSYIKENLCKKTKNDEIGEKEFYGFLQKKNLEIYDMLLIKHKDTIYSKRPNSTTLDMLIKGRYEFINLKPEDQIRVMLEILKLFCTTREVIDLGLIKGKSEAGVTTLGKKISNLDSCILIYQSITGIFEKRIDLLKI

SEQ ID NO: 1692 - protein, 134 aa, Environmental metagenome
NHHMEIWAVLDRSTGKPIKWASETISVLEAHRRYRQGSPIIQRDHGPDTRFCFSLSEGDLVKTRRSERDSERIWYVRSVKADGRVVMSPATDARKKEDISKSGELWQVSVNPLMRLGAAKVVVTPLGKVIYAHD

SEQ ID NO: 1693 - protein, 154 aa, Environmental metagenome
ENYGFVIYENKETGKREYETISFYDAISLARMGLSIVEARPGYRHCVLKHNELIYVLRPGEEKKLINWNDYKNLNNRIYRIVKFTNKRLYAVPHQVAENIVLNEEYENFNEFGSNKNCLEIISDDEPKTKISERCIKINADRLGNIKPAPWEND

SEQ ID NO: 1694 - protein, 142 aa, Environmental metagenome
PRVDVFKKGGKFYYVPIYVADFAKKELPNKIITIGKEKNEWNVADDSYEFLFSLFKDDLIKFKQKGKAEVMGYFLNIGISNCQITYQNINGSKEKNSKGKEFDPYFGGTTLEYIKKYQIDPLGFYYEIKKERRLPVSMKKNN

SEQ ID NO: 1695 - protein, 215 aa, Eubacterium sp.
VRQMFPVNLYEVKEYEADMQGFVTSRIAEASNVKILIPCVKYDACISFDGCRMFITKKTGNRIGYKPGMQLVLGYKYEKYIRNIENYLTKHKDREIIPRDNISAEENIELYDILTGKMLNTVLSVKFSGIGKKLEKRREKFVLCSPEEQCCVLNEILKILHANVLSGDLSLIGESPNTGTMKTNAKFSEIKDVHSIKLINQSVTGLFEQEIDLLK

SEQ ID NO: 1696 - protein, 147 aa, Environmental metagenome
DMVRTDVFRKQNKKGKWEYYLIPVYTVDMISGKLPDKAIAAHKPYNEWPVIDNEYEFLFTLYPYDLIRVETKDGGGLYYYRSSHRANGSLIVCNVNKADTTFGIGSRTAISIEKLEMGVLGDYFPVHKEIRRGLENGSHLEPDKIES

SEQ ID NO: 1697 - protein, 130 aa, Environmental metagenome
DNHRLEIFVAPDGNWTGEAVTVFDANRKDFTPAWQSMTPRPALIMRLHKGDLLEADFGEGRCIWRVVRLEPSAKRVRLVRDFDAGAYEERHKDAEDPFRWNFASYARLQAAAATRVRVDPIGRVLPAREH

SEQ ID NO: 1698 - protein, 118 aa, Environmental metagenome
NHHLAVYRNEEGKLLFRIVSLNEARTALAELGHPVAKTEASAKLLFSLSAGDCLSIPDGDETKLWIVSSTWAEGRVTISETHDAAGQTKTNPSILALVRKGALKVSVDPIGRVRPARD

SEQ ID NO: 1699 - protein, 214 aa, Bifidobacterium bombi
AGNSIHHVRFYKIPKLNSKGKQTGSIYAMLRVLTIDLAMNQYDKETGKKQDLFTLPLPESSLSRRFSEPKLRQALIDGTAEYLGWAVVDDELEIPAFANARITEEQAINGSFTDRLLHSFPGTHKFRFAGFSRNTEIAIRPVQLASEGLIETDENRKRQQLRLTQPNTEYSNSIKNVLKSGLHLKVNTLFQTGILVTRANSQGKQSIRFSTVEE

SEQ ID NO: 1700 - protein, 135 aa, Environmental metagenome
VDLFQNKKTNKYYLVPIYVSDFVQETLPNKAIVAGNKPWLEMDEEYEFKFSFYKSDLIEVKTKKTATKESVQVLGYFNTAVSSTAQVVIDTHDGNEEYRYGTQNLIFVKKYQVDALGNYIEVKNEKRQGTKKQNR

SEQ ID NO: 1701 - protein, 182 aa, Corynebacterium camporealensis
LSRFHHARVYKITSGKKPTYAMLRVYTTDLTAYRNEDLFSVEIKPQTMSMRQAEPKLRKAIAEGQAEYLGWIVIDDELLIDTSSFNSGQIAEMQAEFGMVRRWRLDGFVSPSKLRLRPLQMSGEGLAPGASAGSRKIVDQPGWRPAVNKLLSAGNVTIIRRNSLGQVRLNSNAHLPTTWKVD

SEQ ID NO: 1702 - protein, 134 aa, Environmental metagenome
NYCIEIVRNEKGKWEGEVISTFDAYQLVRQHGIERLRHPSLSVSGKPLAMRLMKNDCVKLQLDNEIITSRVCWVRTDTRIAFAPVSEANVDARDRDKGDQFSYIIKTASVLQKLCARQITITPIGELHDPGFKV

SEQ ID NO: 1703 - protein, 120 aa, Environmental metagenome
NHHMAIYRSIDGKVSYRTVSRIEAARRTARKEPVVQRVLPDGAQLLFTLTPGTTLAFPNNNGRPIYRVVTSVWDSGQIVLVDHTEAGGTVWKRPNASSLVAMGAKKVSVDPIGRVRPARD

SEQ ID NO: 1704 - protein, 188 aa, Legionella pneumophila
NAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 1705 - protein, 124 aa, Environmental metagenome
NHHLEILENPSTGKREMRFVTTMEAAVRARRKNVPVYDRSAPAGWRFLMSLGINDMVEVNQDGGTDYYRVQKLDGGNRRFYLRHHASATTEAREEGLVVSTKSLPLIVRKLSVDPIGQISTAND

SEQ ID NO: 1706 - protein, 146 aa, Environmental metagenome
NNHHVAIYEDEKGNLHEKVVSFYEAVARVNQGLPIIDKSYNKDLGWKFLFTMKQNEMFVFPSNDFNPKEIDLLDKKNQALISKYLFRVQKFSEKDYNFRHHLETQIIDTPQLNNIIAIRKRNPNSLKGVIKIRINHVGDIIQIGEY

SEQ ID NO: 1707 - protein, 127 aa, Environmental metagenome
NHHILIYKSKNGILKEDIISFWVAAERIRQKSPVYQIPADCEEIIAILRKNDMFLIGWDISIPENSTEILSRHLYRVDNLSSLDYVFKHHLTDNDEEKVRIQSFKKWQELNPIKVRISSTGKVIGLV

SEQ ID NO: 1708 - protein, 254 aa, Acidaminococcus_intestini_RyC-MR95
YLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 1709 - protein, 215 aa, Coriobacterium_glomerans_PW2
FFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 1710 - protein, 215 aa, Eggerthella_sp._YY7918
FFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 1711 - protein, 219 aa, Finegoldia_magna_ATCC_29328
FFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 1712 - protein, 236 aa, Lactobacillus_rhamnosus_LOCK900
LAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 1713 - protein, 167 aa, Mycoplasma_gallisepticum_CA06
SIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 1714 - protein, 228 aa, Streptococcus_agalactiae_NEM316
SVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1715 - protein, 231 aa, Streptococcus_dysgalactiae_subsp._equisimilis_AC-2713
SVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1716 - protein, 222 aa, Streptococcus_gallolyticus_subsp._gallolyticus_ATCC_43143
SVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 1717 - protein, 173 aa, Streptococcus_gordonii_str._Challis_substr._CH1
NTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 1718 - protein, 222 aa, Streptococcus_mutans_GS-5]
SILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1719 - protein, 158 aa, Streptococcus_salivarius_JIM8777
PWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 1720 - protein, 159 aa, Streptococcus_suis_D9
PWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 1721 - protein, 158 aa, Streptococcus_thermophilus_LMG_18311
PWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 1722 - protein, 260 aa, Treponema_denticola_ATCC_35405
YTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 1723 - protein, 209 aa, Lactobacillus animalis KCTC 3501
AVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 1724 - protein, 245 aa, Lactobacillus ceti DSM 22408
YSIYKYTYMKKKECMEEFLLVPIPIHLVNNDEELPKYINDKIAERAKKKKLETVECIVKELYQGTLVRINGYDYRIAGSSGKQFELHNGINLIVEPWVEKVLKETDKFVRKSNSKLDKKQQKENTTETLIEKQLNDVFEYLCRKLNQGIFKNNKHTLPAKLLGDSIQKRFEDASIEDEFEVIKELISAIAKNPQNFKTIQKVLDISGSSIPRFNLKLTKNNVDEFIIKNESVTGLFTHEKVIFRK

SEQ ID NO: 1725 - protein, 251 aa, Tissierellia bacterium KA00581
FVLFKYEEKGKEKIGFDSITIAYKERLKKNLDIEKFLENKGYKNSKLIRKIFKNQKVLINGYPYLLKSFNKQSQIKFNNFKILYLNENNLKFAKDAIKFEKNNANVDLKKQKYIVSFLKKKKQNEINETYEECIDRLNDEFDTLFLKLCDIQKSSIYTNYKLQDFSSNKKSIEIKDKFDIFKSLDLYKKSKLIKEFLNYYKYEKNDLDFSLIDIDKKANCIQKHFTEDLVKDFVIVDESVTGLFVKKERLK

SEQ ID NO: 1726 - protein, 240 aa, Veillonella parvula ATCC 17745
SIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 1727 - protein, 133 aa, Environmental metagenome
HHVMIYKDSDGQLKESIVTLWEAAERKNQGNSVYQLPPDGLEVVSTLAVNDMFLLGLETEQNKDIKKLDYQILSKHLYRVQKLSSMYYTFRHHLASTVTNSDEEFSIRSFGTWEKVNPIRVKVNQIGEVIRSL

SEQ ID NO: 1728 - protein, 212 aa, Enterococcus faecalis OG1RF
TVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 1729 - protein, 87 aa, Streptococcus gallolyticus
NDLIKLNGDLYKIIGVNSDDRNIIELDYYDIKYKDYCEINNIKGEPRIKKTIGKKTESIEKFTTDVLGNLYLHSTEKAPQLIFKRGL

SEQ ID NO: 1730 - protein, 145 aa, Staphylococcus pasteuri
KCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMP

SEQ ID NO: 1731 - DNA, 31 bp, Artificial
  Adapter A1
cggcattcctgctgaaccgctcttccgatct

SEQ ID NO: 1732 - DNA, 30 bp, Artificial
  Adapter A2
gatcggaagagcggttcagcaggaatgccg

SEQ ID NO: 1733 - DNA, 22 bp, Artificial
  R0 primer
gccagggttttcccagtcacga

SEQ ID NO: 1734 - DNA, 28 bp, Artificial
  C0 primer
gaaattctaaacgctaaagaggaagagg

SEQ ID NO: 1735 - DNA, 56 bp, Artificial
  F1 primer
ctacactctttccctacacgacgctcttccgatctaaggcggcattcctgctgaac

SEQ ID NO: 1736 - DNA, 49 bp, Artificial
  R1 primer
caagcagaagacggcatacgagctcttccgatctcggcgacgttgggtc

SEQ ID NO: 1737 - DNA, 35 bp, Artificial
  5' end bridge amplification sequence
ctacactctttccctacacgacgctcttccgatct

SEQ ID NO: 1738 - DNA, 34 bp, Artificial
  3' end bridge amplification sequence
caagcagaagacggcatacgagctcttccgatct

SEQ ID NO: 1739 - DNA, 43 bp, Artificial
  F2 primer
aatgatacggcgaccaccgagatctacactctttccctacacg

SEQ ID NO: 1740 - DNA, 18 bp, Artificial
  R2 primer
caagcagaagacggcata

SEQ ID NO: 1741 - DNA, 60 bp, Artificial
  C1 primer
ctacactctttccctacacgacgctcttccgatctggaataaacgctaaagaggaagagg

SEQ ID NO: 1742 - DNA, 13 bp, Artificial
  sequence product
cttccgatctaca

SEQ ID NO: 1743 - DNA, 10 bp, Artificial
  adapter and target sequences of sequence produced
cttccgatct

SEQ ID NO: 1744 - DNA, 10 bp, Artificial
  5' sequence upstream of the PAM
agttgaccca

SEQ ID NO: 1745 - DNA, 10 bp, Artificial
  Protospacer adjacent motif (PAM) preference consensus for ID33 Clade 5`
  misc_feature (1)..(4): n is a, c, g, or t
  misc_feature (9)..(10): n is a, c, g, or t
nnnncvgann

SEQ ID NO: 1746 - DNA, 76 bp, Clostridium perfringens
ctagataatttcagcggcaaattattaactgggatgtgaactgacgagggaaaatggcttacagatcttttgcttt

SEQ ID NO: 1747 - DNA, 76 bp, Artificial
  Cleavage mutant
ctagataatttcagcggcaaattattaactgggatgtgaactgacgagggaaaattggcttacagatcttttgctt

SEQ ID NO: 1748 - DNA, 75 bp, Artificial
  Cleavage mutant
ctagataatttcagcggcaaattattaactgggatgtgaactgacgagggaaaaggcttacagatcttttgcttt

SEQ ID NO: 1749 - DNA, 76 bp, Artificial
  Cleavage mutant
ctagataatttcagcggcaaattattaactgggatgtgaactgacgagggaaaaatggcttacagatcttttgctt

SEQ ID NO: 1750 - DNA, 76 bp, Artificial
  Cleavage mutant
ctagataatttcagcggcaaattattaactgggatgtgaactgacgagggaaaagtggcttacagatcttttgctt

SEQ ID NO: 1751 - DNA, 74 bp, Artificial
  Cleavage mutant
ctagataatttcagcggcaaattattaactgggatgtgaactgacgagggaatggcttacagatcttttgcttt

SEQ ID NO: 1752 - DNA, 76 bp, Artificial
  Cleavage mutant
ctagataatttcagcggcaaattattaactgggatgtgaactgacgagggaaaactggcttacagatcttttgctt

SEQ ID NO: 1753 - DNA, 55 bp, Artificial
  Cleavage mutant
ctagataatttcagcggcaaattattaactgggatgtgaacagatcttttgcttt

SEQ ID NO: 1754 - DNA, 74 bp, Artificial
  Cleavage mutant
ctagataatttcagcggcaaattattaactgggatgtgaactgacgagggaaaggcttacagatcttttgcttt

SEQ ID NO: 1755 - DNA, 76 bp, Artificial
  Cleavage mutant
ctagataatttcagcggcaaattattaactgggatgtgaactgacgagggaaaatggactacagatcttttgcttt

SEQ ID NO: 1756 - DNA, 74 bp, Artificial
  Cleavage mutant
ctagataatttcagcggcaaattattaactgggatgtgaactgacgagggaaaagcttacagatcttttgcttt

SEQ ID NO: 1757 - DNA, 51 bp, Artificial
  Cleavage mutant
ctagataatttcagcggcaaattattaactggcttacagatcttttgcttt

SEQ ID NO: 1758 - DNA, 72 bp, Artificial
  Cleavage mutant
ctagataatttcagcggcaaattattaactgggatgtgaactgacgagggaaaattacagatcttttgcttt

SEQ ID NO: 1759 - DNA, 73 bp, Artificial
  Cleavage mutant
ctagataatttcagcggcaaattattaactgggatgtgaactgacgagggatggcttacagatcttttgcttt

SEQ ID NO: 1760 - DNA, 69 bp, Artificial
  Cleavage mutant
ctagataatttcagcggcaaattattaactgggatgtgaactgacgagggcttacagatcttttgcttt

SEQ ID NO: 1761 - DNA, 58 bp, Artificial
  Cleavage mutant
ctagataatttcagcggcaaattattaactgggatgtggcttacagatcttttgcttt

SEQ ID NO: 1762 - DNA, 73 bp, Artificial
  Cleavage mutant
ctagataatttcagcggcaaattattaactgggatgtgaactgacgagggaaaacttacagatcttttgcttt

SEQ ID NO: 1763 - DNA, 73 bp, Artificial
  Cleavage mutant
ctagataatttcagcggcaaattattaactgggatgtgaactgacgagggaaggcttacagatcttttgcttt

SEQ ID NO: 1764 - DNA, 63 bp, Artificial
  Cleavage mutant
ctagataatttcagcggcaaattattaactgggatgtgaactggcttacagatcttttgcttt

SEQ ID NO: 1765 - DNA, 69 bp, Artificial
  Cleavage mutant
ctagataatttcagcggcaaattattaactgggatgtgaactgacgatggcttacagatcttttgcttt

SEQ ID NO: 1766 - DNA, 52 bp, Artificial
  Cleavage mutant
ctagataatttcagcggcaaattattaactgggcttacagatcttttgcttt

SEQ ID NO: 1767 - DNA, 76 bp, Streptococcus equinus
ttcctcagctgctccaccgttgcgccgatgactggccatgatctcgggcctttctgcttcctcaggctccacctct

SEQ ID NO: 1768 - DNA, 76 bp, Artificial
  Cleavage mutant
ttcctcagctgctccaccgttgcgccgatgactggccatgatctcgggcctttctgcttacctcaggctccacctc

SEQ ID NO: 1769 - DNA, 76 bp, Artificial
  Cleavage mutant
ttcctcagctgctccaccgttgcgccgatgactggccatgatctcgggcctttctgctttcctcaggctccacctc

SEQ ID NO: 1770 - DNA, 75 bp, Artificial
  Cleavage mutant
ttcctcagctgctccaccgttgcgccgatgactggccatgatctcgggcctttctgcttctcaggctccacctct

SEQ ID NO: 1771 - DNA, 75 bp, Artificial
  Cleavage mutant
ttcctcagctgctccaccgttgcgccgatgactggccatgatctcgggcctttctgctcctcaggctccacctct

SEQ ID NO: 1772 - DNA, 72 bp, Artificial
  Cleavage mutant
ttcctcagctgctccaccgttgcgccgatgactggccatgatctcgggcctttctgcttaggctccacctct

SEQ ID NO: 1773 - DNA, 73 bp, Artificial
  Cleavage mutant
ttcctcagctgctccaccgttgcgccgatgactggccatgatctcgggcctttctgcttcaggctccacctct

SEQ ID NO: 1774 - DNA, 76 bp, Artificial
  Cleavage mutant
ttcctcagctgctccaccgttgcgccgatgactggccatgatctcgggcctttctgcttccctcaggctccacctc

SEQ ID NO: 1775 - DNA, 73 bp, Artificial
  Cleavage mutant
ttcctcagctgctccaccgttgcgccgatgactggccatgatctcgggcctttctgcctcaggctccacctct

SEQ ID NO: 1776 - DNA, 72 bp, Artificial
  Cleavage mutant
ttcctcagctgctccaccgttgcgccgatgactggccatgatctcgggcctttctgctcaggctccacctct

SEQ ID NO: 1777 - DNA, 76 bp, Artificial
  Cleavage mutant
ttcctcagctgctccaccgttgcgccgatgactggccatgatctcgggcctttctgcttttcctcaggctccacct

SEQ ID NO: 1778 - DNA, 71 bp, Artificial
  Cleavage mutant
ttcctcagctgctccaccgttgcgccgatgactggccatgatctcgggcctttctgcttggctccacctct

SEQ ID NO: 1779 - DNA, 74 bp, Artificial
  Cleavage mutant
ttcctcagctgctccaccgttgcgccgatgactggccatgatctcgggcctttctgctttcaggctccacctct

SEQ ID NO: 1780 - DNA, 58 bp, Artificial
  Cleavage mutant
ttcctcagctgctccaccgttgcgccgatgactggccatgacctcaggctccacctct

SEQ ID NO: 1781 - DNA, 70 bp, Artificial
  Cleavage mutant
ttcctcagctgctccaccgttgcgccgatgactggccatgatctcgggcctttcctcaggctccacctct

SEQ ID NO: 1782 - DNA, 66 bp, Artificial
  Cleavage mutant
ttcctcagctgctccaccgttgcgccgatgactggccatgatctcgggcctttctgctccacctct

SEQ ID NO: 1783 - DNA, 58 bp, Artificial
  Cleavage mutant
ttcctcagctgctccaccgttgcgccgatgactggccatgatctcaggctccacctct

SEQ ID NO: 1784 - DNA, 67 bp, Artificial
  Cleavage mutant
ttcctcagctgctccaccgttgcgccgatgactggccatgatctcgggcctttctgcctccacctct

SEQ ID NO: 1785 - DNA, 64 bp, Artificial
  Cleavage mutant
ttcctcagctgctccaccgttgcgccgatgactggccatgatctcgggcctttctgccacctct

SEQ ID NO: 1786 - DNA, 70 bp, Artificial
  Cleavage mutant
ttcctcagctgctccaccgttgcgccgatgactggccatgatctcgggcctttctgcttgctccacctct

SEQ ID NO: 1787 - DNA, 55 bp, Artificial
  Cleavage mutant
ttcctcagctgctccaccgttgcgccgatgactggccatgatctcgggcctttct

SEQ ID NO: 1788 - DNA, 79 bp, Nitratifractor salsuginis
gtaatcgaactgtgggttcccgccacgttcagaatggcttggactcaagtgtaaatgtacagggttcagttttgtaata

SEQ ID NO: 1789 - DNA, 79 bp, Artificial
  Cleavage mutant
gtaatcgaactgtgggttcccgccacgttcagaatggcttggactcaagtgtaaattgtacagggttcagttttgtaat

SEQ ID NO: 1790 - DNA, 79 bp, Artificial
  Cleavage mutant
gtaatcgaactgtgggttcccgccacgttcagaatggcttggactcaagtgtaaatatgtacagggttcagttttgtaa

SEQ ID NO: 1791 - DNA, 73 bp, Artificial
  Cleavage mutant
gtaatcgaactgtgggttcccgccacgttcagaatggcttggactcaagtgtacagggttcagttttgtaata

SEQ ID NO: 1792 - DNA, 78 bp, Artificial
  Cleavage mutant
gtaatcgaactgtgggttcccgccacgttcagaatggcttggactcaagtgtaatgtacagggttcagttttgtaata

SEQ ID NO: 1793 - DNA, 79 bp, Artificial
  Cleavage mutant
gtaatcgaactgtgggttcccgccacgttcagaatggcttggactcaagtgtaaaatgtacagggttcagttttgtaat

SEQ ID NO: 1794 - DNA, 77 bp, Artificial
  Cleavage mutant
gtaatcgaactgtgggttcccgccacgttcagaatggcttggactcaagtgtaaatacagggttcagttttgtaata

SEQ ID NO: 1795 - DNA, 79 bp, Artificial
  Cleavage mutant
gtaatcgaactgtgggttcccgccacgttcagaatggcttggactcaagtgtaaatttgtacagggttcagttttgtaa

SEQ ID NO: 1796 - DNA, 79 bp, Artificial
  Cleavage mutant
gtaatcgaactgtgggttcccgccacgttcagaatggcttggactcaagtgtaaattgtccagggttcagttttgtaat

SEQ ID NO: 1797 - DNA, 77 bp, Artificial
  Cleavage mutant
gtaatcgaactgtgggttcccgccacgttcagaatggcttggactcaagtgtatgtacagggttcagttttgtaata

SEQ ID NO: 1798 - DNA, 72 bp, Artificial
  Cleavage mutant
gtaatcgaactgtgggttcccgccacgttcagaatggcttggactcaatgtacagggttcagttttgtaata

SEQ ID NO: 1799 - DNA, 64 bp, Artificial
  Cleavage mutant
gtaatcgaactgtgggttcccgccacgttcagaatggcttggactcaagtgtaaatgtaccggg

SEQ ID NO: 1800 - DNA, 74 bp, Artificial
  Cleavage mutant
gtaatcgaactgtgggttcccgccacgttcagaatggcttggactcaagtgtaaattttacagggtccagtttt

SEQ ID NO: 1801 - DNA, 75 bp, Artificial
  Cleavage mutant
gtaatcgaactgtgggttcccgccacgttcagaatggcttggactcaagtgtgtacagggttcagttttgtaata

SEQ ID NO: 1802 - DNA, 70 bp, Artificial
  Cleavage mutant
gtaatcgaactgtgggttcccgccacgttcagaatggcttggactctgtacagggttcagttttgtaata

SEQ ID NO: 1803 - DNA, 76 bp, Artificial
  Cleavage mutant
gtaatcgaactgtgggttcccgccacgttcagaatggcttggactcaagtgtaaatcagggttcagttttgtaata

SEQ ID NO: 1804 - DNA, 79 bp, Artificial
  Cleavage mutant
gtaatcgaactgtgggttcccgccacgttcagaatggcttggactcaagtgtaaatgtgtacagggttcagttttgtaa

SEQ ID NO: 1805 - DNA, 78 bp, Artificial
  Cleavage mutant
gtaatcgaactgtgggttcccgccacgttcagaatggcttggactcaagtgtaaataaaaaaaattctgatctgtaaa

SEQ ID NO: 1806 - DNA, 79 bp, Artificial
  Cleavage mutant
gtaatcgaactgtgggttcccgccacgttcagaatggcttggactcaagtgtaaattatgtacagggttcagttttgta

SEQ ID NO: 1807 - DNA, 77 bp, Artificial
  Cleavage mutant
gtaatcgaactgtgggttcccgccacgttcagaatggcttggactcaagtgtaagtacagggttcagttttgtaata

SEQ ID NO: 1808 - DNA, 78 bp, Artificial
  Cleavage mutant
gtaatcgaactgtgggttcccgccacgttcagaatggcttggactcaagtgtaaattacagggttcagttttgtaata

SEQ ID NO: 1809 - DNA, 80 bp, Turicibacter sp.
cccagaggtatccagcagaggggagaagaaagagagatgtagggctagaggggtgaggctgaaacagtgacctgtcttgg

SEQ ID NO: 1810 - DNA, 79 bp, Artificial
  Cleavage mutant
cccagaggtatccagcagaggggagaagaaagagagatgtagggctagaggggtgaaaaaaaagccccagtgaggggct

SEQ ID NO: 1811 - DNA, 74 bp, Artificial
  Cleavage mutant
cccagaggtatccagcagaggggagaagaaagagagatgtagggctagagggctgaaacagtgacctgtcttgg

SEQ ID NO: 1812 - DNA, 79 bp, Artificial
  Cleavage mutant
cccagaggtatccagcagaggggagaagaaagagagatgtagggctagaggggtgggctgaaacagtgacctgtcttgg

SEQ ID NO: 1813 - DNA, 80 bp, Artificial
  Cleavage mutant
cccagaggtatccagcagaggggagaagaaagagagatgtagggctagaggggtgatggctgaaacagtgacctgtcttg

SEQ ID NO: 1814 - DNA, 74 bp, Artificial
  Cleavage mutant
cccagaggtatccagcagaggggagaagaaagagagatgtagggctagaggggtgaaacagtgacctgtcttgg

SEQ ID NO: 1815 - DNA, 80 bp, Artificial
  Cleavage mutant
cccagaggtatccagcagaggggagaagaaagagagatgtagggctagaggggtgaaggctgaaacagtgacctgtcttg

SEQ ID NO: 1816 - DNA, 80 bp, Artificial
  Cleavage mutant
cccagaggtatccagcagaggggagaagaaagagagatgtagggctagaggggtgacggctgaaacagtgacctgtcttg

SEQ ID NO: 1817 - DNA, 79 bp, Artificial
  Cleavage mutant
cccagaggtatccagcagaggggagaagaaagagagatgtagggctagaggggtgaaaaaaagccccagtgaggggctg

SEQ ID NO: 1818 - DNA, 78 bp, Artificial
  Cleavage mutant
cccagaggtatccagcagaggggagaagaaagagagatgtagggctagaggggtggctgaaacagtgacctgtcttgg

SEQ ID NO: 1819 - DNA, 79 bp, Artificial
  Cleavage mutant
cccagaggtatccagcagaggggagaagaaagagagatgtagggctagaggggtgaaaggctttatgccgaaatcagcc

SEQ ID NO: 1820 - DNA, 79 bp, Artificial
  Cleavage mutant
cccagaggtatccagcagaggggagaagaaagagagatgtagggctagaggggtgagctgaaacagtgacctgtcttgg

SEQ ID NO: 1821 - DNA, 66 bp, Artificial
  Cleavage mutant
cccagaggtatccagcagaggggagaagaaagagagatgtagggctgaaacagtgacctgtcttgg

SEQ ID NO: 1822 - DNA, 66 bp, Artificial
  Cleavage mutant
cccagaggtatccagcagaggggagaagaaagagagatgtagggctagaggggtgacctgtcttgg

SEQ ID NO: 1823 - DNA, 73 bp, Artificial
  Cleavage mutant
cccagaggtatccagcagaggggagaagaaagagagatgtagggctagaggctgaaacagtgacctgtcttgg

SEQ ID NO: 1824 - DNA, 79 bp, Artificial
  Cleavage mutant
cccagaggtatccagcagaggggagaagaaagagagatgtagggctagaggggtgaatccagcgccagcaataccggag

SEQ ID NO: 1825 - DNA, 79 bp, Artificial
  Cleavage mutant
cccagaggtatccagcagaggggagaagaaagagagatgtagggctagaggggtgaggccttcccctgaggctgtgtgc

SEQ ID NO: 1826 - DNA, 70 bp, Artificial
  Cleavage mutant
cccagaggtatccagcagaggggagaagaaagagagatgtagggctggctgaaacagtgacctgtcttgg

SEQ ID NO: 1827 - DNA, 79 bp, Artificial
  Cleavage mutant
cccagaggtatccagcagaggggagaagaaagagagatgtagggctagaggggtgaaaccggttcggctggcaatctgt

SEQ ID NO: 1828 - DNA, 79 bp, Artificial
  Cleavage mutant
cccagaggtatccagcagaggggagaagaaagagagatgtagggctagaggggtgactggcgatggcgttgatggggct

SEQ ID NO: 1829 - DNA, 79 bp, Artificial
  Cleavage mutant
cccagaggtatccagcagaggggagaagaaagagagatgtagggctagaggggtgacagcatacaagggatgtgaagga

We claim:

1. A synthetic composition comprising a heterologous target polynucleotide and a Cas polypeptide comprising at least 90% amino acid sequence identity with SEQ ID NO: 120, wherein the Cas polypeptide recognizes a N(T>C>R)AGAN(A>K>C)NN PAM sequence, wherein N=A, C, G, or T; R=A or G; and K=G or T.

2. The synthetic composition of claim 1, wherein the Cas polypeptide comprises a domain sharing 90% or greater identity with a sequence selected from the group consisting of SEQ ID NO: 1170, SEQ ID NO: 1255, SEQ ID NO: 1340, SEQ ID NO: 1425, SEQ ID NO: 1510, SEQ ID NO: 1595, and SEQ ID NO: 1680.

3. The synthetic composition of claim 1, wherein the Cas polypeptide is fused to a heterologous polypeptide.

4. The synthetic composition of claim 3, wherein the heterologous polypeptide comprises nuclease activity.

5. The synthetic composition of claim 3, wherein the heterologous polypeptide is a deaminase.

6. The synthetic composition of claim 1, wherein the Cas polypeptide has been modified to lack endonuclease activity.

7. The synthetic composition of claim 1, wherein the Cas polypeptide has been modified to nick a single strand of the target polynucleotide.

8. The synthetic composition of claim 1, wherein the Cas polypeptide has been modified to comprise a heterologous nuclease domain, a transcriptional activator domain, a transcriptional repressor domain, an epigenetic modification domain, a cleavage domain, a nuclear localization signal, a cell-penetrating domain, a deaminase domain, a base editing domain, or a translocation domain.

9. A polynucleotide encoding the Cas polypeptide of claim 1.

10. A plasmid comprising the polynucleotide of claim 9.

11. The plasmid of claim 10, further comprising an expression element operably linked to the polynucleotide encoding the Cas polypeptide.

12. The plasmid of claim 10, further comprising a gene encoding a selectable marker or a transgene.

13. The synthetic composition of claim 1, further comprising a heterologous polynucleotide, a heterologous polypeptide, a particle, a solid matrix, an antibody, Tris, EDTA, dithiothreitol (DTT), phosphate-buffered saline (PBS), sodium chloride, magnesium chloride, HEPES, glycerol, bovine serum albumin (BSA), a salt, an emulsifier, a detergent, a chelating agent, a proteinase, Proteinase K, a redox reagent, an antibody, nuclease-free water, a viscosity agent, or a Histidine tag.

14. The synthetic composition of claim 1, wherein the Cas polypeptide is in a liquid formulation.

15. The synthetic composition of claim 1, wherein the Cas polypeptide is in a lyophilized formulation.

16. The synthetic composition of claim 1, wherein the Cas polypeptide is in a formulation with a pH of between 1.0 and 14.0, between 2.0 and 13.0, between 3.0 and 12.0, between 4.0 and 11.0, between 5.0 and 10.0, between 6.0 and 9.0, between 7.0 and 8.0, between 4.5 and 6.5, between 5.5 and 7.5, or between 6.5 and 7.5.

17. The synthetic composition of claim 1, wherein the Cas polypeptide is stored or incubated at a temperature of at least minus 200 degrees Celsius, at least minus 150 degrees Celsius, at least minus 135 degrees Celsius, at least minus 90 degrees Celsius, at least minus 80 degrees Celsius, at least minus 20 degrees Celsius, at least 4 degrees Celsius, at least 17 degrees Celsius, at least 20 degrees Celsius, at least 25 degrees Celsius, at least 30 degrees Celsius, at least 35 degrees Celsius, at least 37 degrees Celsius, at least 39 degrees Celsius, at least 40 degrees Celsius, at least 45 degrees Celsius, at least 50 degrees Celsius, at least 55 degrees Celsius, at least 60 degrees Celsius, at least 65 degrees Celsius, at least 70 degrees Celsius, or greater than 70 degrees Celsius.

18. The synthetic composition of claim 1, wherein the Cas polypeptide is attached to a solid matrix.

19. The synthetic composition of claim 1, wherein the solid matrix is a particle.

20. A kit comprising the synthetic composition of claim 1.

21. The synthetic composition of claim 1, further comprising a guide polynucleotide.

22. The synthetic composition of claim 1, further comprising a heterologous cell.

23. The synthetic composition of claim 22, wherein the cell is obtained from a eukaryotic, prokaryotic, plant, or animal organism.

24. A Cas polypeptide comprising at least 90% amino acid sequence identity with SEQ ID NO: 120, wherein the Cas polypeptide recognizes a N(T>C>R)AGAN(A>K>C)NN PAM sequence, wherein N=A, C, G, or T; R=A or G; and K=G or T.

25. A method of creating a double strand break in a target polynucleotide, the method comprising contacting the target polynucleotide with a guide polynucleotide that shares complementarity with the target nucleotide, and a Cas endonuclease comprising at least 90% amino acid sequence identity with SEQ ID NO: 120, wherein the Cas polypeptide recognizes a N(T>C>R)AGAN(A>K>C)NN PAM sequence, wherein N=A, C, G, or T; R=A or G; and K=G or T, and wherein the Cas endonuclease and the guide RNA form a complex that recognizes, binds to, and cleaves the target polynucleotide.

26. The method of claim 25, wherein the double strand break comprises a blunt end.

27. A method of modifying a DNA target site, the method comprising:
  (a) contacting a polynucleotide comprising the DNA target site with a Cas polypeptide comprising at least 90% amino acid sequence identity with SEQ ID NO:120, wherein the Cas polypeptide recognizes a N(T>C>R)AGAN(A>K>C)NN PAM sequence, wherein N=A, C, G, or T; R=A or G; and K=G or T;
  (b) a guide polynucleotide that shares complementarity with a sequence in or near the DNA target site, wherein the Cas polypeptide and the guide RNA form a complex that recognizes, binds to, and nicks or cleaves the DNA target site; and
  (c) detecting at least one modification at the DNA target site.

28. The method of claim 27, further comprising introducing a donor DNA molecule in step (a), wherein the donor DNA molecule is integrated into the target site.

29. The method of claim 27, further comprising introducing a template DNA molecule in step (a), wherein the template DNA molecule directs the repair outcome of the cleavage site.

30. A method of editing at least one base of a target polynucleotide, comprising:
  (a) contacting the target polynucleotide with:
    (i) a deaminase,
    (ii) a Cas polypeptide comprising at least 90% amino acid sequence identity with SEQ ID NO: 120, wherein the Cas polypeptide has been modified to lack nuclease activity, wherein the Cas polypeptide recognizes a N(T>C>R)AGAN(A>K>C)NN PAM sequence, wherein N=A, C, G, or T; R=A or G; and K=G or T, and
    (iii) a guide polynucleotide that shares complementarity with a sequence of the target polynucleotide, wherein the Cas polypeptide and the guide RNA form a complex that recognizes and binds to the target polynucleotide; and
  (b) detecting at least one modification in the target polynucleotide.

31. The method of claim 30, wherein the Cas polypeptide has been modified to lack endonuclease activity.

32. A method of modifying the genome of a cell, the method comprising:
   (a) introducing into the cell a guide polynucleotide that shares complementarity with a sequence in or near a DNA target site in the cell, and a heterologous Cas polypeptide comprising at least 90% amino acid sequence identity with SEQ ID NO: 120, wherein the Cas polypeptide recognizes a N(T>C>R)AGAN(A>K>C)NN PAM sequence, wherein N=A, C, G, or T; R=A or G; and K=G or T, and wherein the Cas polypeptide and the guide RNA form a complex that recognizes, binds to, and nicks or cleaves the DNA target site; and
   (b) identifying at least one modification, as compared to an isoline cell not introduced to the Cas polypeptide and guide polynucleotide.

33. The method of claim 32, further comprising introducing a heterologous polynucleotide in step (a), wherein the heterologous polynucleotide is a donor DNA or a template DNA.

34. The method of claim 32, wherein the cell is removed from a source organism prior to step (a) and re-introduced into either the source organism or introduced into a new organism after step (a).

35. The method of claim 32, wherein the cell is placed in a medium that supports growth, and a tissue or organism is regenerated from the cell.

36. The method of claim 32, wherein the method of modifying the genome of the cell results in a benefit to an organism obtained or derived from the cell.

37. The method of claim 36, wherein the organism is a plant.

38. The method of claim 37, wherein the plant is selected from the group consisting of maize, rice, sorghum, rye, barley, wheat, millet, oats, sugarcane, turfgrass, switchgrass, soybean, canola, alfalfa, sunflower, cotton, tobacco, peanut, potato, tobacco, *Arabidopsis*, vegetable, and safflower.

39. The method of claim 37, wherein the benefit is selected from the group consisting of: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, improved fertility, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition; as compared to an isoline plant not comprising said target site modification or as compared to the plant prior to the modification of said target site in said plant cell.

40. The method of claim 36, wherein the organism is an animal.

41. The method of claim 40, wherein the animal is a human.

42. The method of claim 36, wherein the cell is an animal cell selected from the group consisting of: haploid cells, diploid cells, reproductive cells, neurons, muscle cells, endocrine or exocrine cells, epithelial cells, muscle cells, kidney cells, ovarian cells, tumor cells, embryonic cells, hematopoietic cells, bone cells, germ cells, somatic cells, stem cells, pluripotent stem cells, induced pluripotent stem cells, progenitor cells, meiotic cells, and mitotic cells.

43. The method of claim 32, wherein the cell is selected from the group consisting of: a human, non-human primate, mammal, animal, archaeal, bacterial, protist, fungal, insect, yeast, non-conventional yeast, and plant cell.

* * * * *